United States Patent
Genee et al.

(10) Patent No.: US 11,851,461 B2
(45) Date of Patent: Dec. 26, 2023

(54) CELL FACTORY HAVING IMPROVED IRON-SULFUR CLUSTER DELIVERY

(71) Applicant: BIOSYNTIA APS, Copenhagen Ø (DK)

(72) Inventors: Hans Jasper Genee, Copenhagen N (DK); Anne Pihl Bali, Copenhagen NV (DK); Nils Myling-Petersen, Copenhagen Ø (DK)

(73) Assignee: BIOSYNTIA APS, Copenhagen Ø (DK)

( * ) Notice: Subject to any disclaimer, the term of this patent is extended or adjusted under 35 U.S.C. 154(b) by 1018 days.

(21) Appl. No.: 16/630,203

(22) PCT Filed: Jul. 12, 2018

(86) PCT No.: PCT/EP2018/068989
§ 371 (c)(1),
(2) Date: Jan. 10, 2020

(87) PCT Pub. No.: WO2019/012058
PCT Pub. Date: Jan. 17, 2019

(65) Prior Publication Data
US 2023/0192778 A1    Jun. 22, 2023

(30) Foreign Application Priority Data

Jul. 14, 2017  (EP) .................................... 17181503

(51) Int. Cl.
| | |
|---|---|
| C12N 9/00 | (2006.01) |
| C07K 14/245 | (2006.01) |
| C12N 9/10 | (2006.01) |
| C12N 9/88 | (2006.01) |
| C12N 15/70 | (2006.01) |
| C12N 15/77 | (2006.01) |

(52) U.S. Cl.
CPC .............. *C07K 14/245* (2013.01); *C12N 9/13* (2013.01); *C12N 9/88* (2013.01); *C12N 9/93* (2013.01); *C12N 15/70* (2013.01); *C12N 15/77* (2013.01)

(58) Field of Classification Search
CPC .............. C12N 9/13; C12N 9/93; C12N 9/00
See application file for complete search history.

(56) References Cited

U.S. PATENT DOCUMENTS

| | | |
|---|---|---|
| 2004/0235123 A1 | 11/2004 | Liao et al. |
| 2007/0087419 A1 | 4/2007 | Clack et al. |
| 2011/0262976 A1 | 10/2011 | Kandula et al. |
| 2019/0382815 A1 | 12/2019 | Gronenberg et al. |

FOREIGN PATENT DOCUMENTS

| | | |
|---|---|---|
| CN | 106086052 | 11/2016 |

OTHER PUBLICATIONS

Yirong Sun et al: "Overproduction of [alpha]-Lipoic Acid by Gene Manipulated *Escherichia coli*", PLOS ONE, vol. 12, No. 1, Jan. 9, 2017 (Jan. 9, 2017), pp. e0169369, XP055391544.
Datsenko KA; Wanner BL: "One-step inactivation of chromosomal genes in *Escherichia coli* K-12 using PCR products", Proc Natl Acad Sci U S A, vol. 97, No. 12, 2000, pp. 6640-6645, XP002210218.
Giel, J. L.; Rodionov, D.; Liu, M.; Blattner, F. R.; Kiley, P. J.: "IscR-dependent gene expression links iron-sulphur cluster assembly to the control of 02-regulated genes in *Escherichia coli*", Mol. Microbiol., vol. 60, 2006, pp. 1058-1075, XP055429111.
Ifuku, O. et al.: "Molecular analysis of growth inhibition caused by overexpression of the biotin operon in *Escherichia coli*", Bioscience, Biotechnology, and Biochemistry, vol. 59, No. 2, 1995, pp. 184-189.
Ifuku, O. et al.: "Sequencing analysis of mutation points in the biotin operon of biotin-overproducing *Escherichia coli* mutants", Biosci Biotechnol Biochem, vol. 57, 1993, pp. 760-765.
Schmitt, A; Kochanowski K.; Vedelaar S.; Ahrne E.; Volkmer B.; Callipo L.; Knoops K.; Bauer M.; Aebersold R.; Heinemann M.: "The quantitative and condition-dependent *Escherichia coli* proteome", Nature Biotechnology (Jul. 1, 2016).
Angela S. Fleischhacker et al: "Characterization of the [2Fe—2S] Cluster of *Escherichia coli* Transcription Factor IscR", Biochemistry, vol. 51, No. 22, Jun. 5, 2012 (Jun. 5, 2012), US, pp. 4453-4462, XP055428859, ISSN: 0006-2960.
Martin, J. E.; Imlay, J. A.: "Replication During Periods of Iron Starvation", vol. 80, 2012, pp. 319-334.

*Primary Examiner* — Tekchand Saidha
(74) *Attorney, Agent, or Firm* — DUANE MORRIS LLP; Gregory M. Lefkowitz

(57) ABSTRACT

The invention provides a genetically modified bacterial cell capable of improved iron-sulfur cluster delivery, characterized by a modified gene encoding a mutant Iron Sulfur Cluster Regulator (IscR) as well as one or more transgenes encoding polypeptides that enhance the biosynthesis of either biotin, lipoic acid or thiamine. The invention provides a method for producing either biotin, lipoic acid or thiamine using the genetically modified bacterium of the invention; as well as for the use of the genetically modified bacterial cell for either biotin, lipoic acid or thiamine production.

18 Claims, 12 Drawing Sheets

Specification includes a Sequence Listing.

A

**Characterization of *iscR* H107Y, 0.01 mM IPTG**

B

**Characterization of *iscR* H107Y, 0.5 mM IPTG**

— BS1375 (H107Y) + pBS412, OD600
-- BS1011 (Ref) + pBS412, OD600
• BS1375 (H107Y) + pBS412, biotin
• BS1011 (Ref) + pBS412, biotin

Correlation of BioB expression and biotin production

[1] BS1013+pBS430, 0.025 mM IPTG
[2] BS1011+pBS412, 0.025 mM IPTG
[3] BS1353+pBS412, 0.025 mM IPTG
[4] BS1353+pBS412, 1 mM IPTG

Lipoic Acid production from Octanoic Acid

Growth profiles BS1912 (WT) and BS2114 (C92Y) with pBS1037

US 11,851,461 B2

CELL FACTORY HAVING IMPROVED IRON-SULFUR CLUSTER DELIVERY

CROSS-REFERENCE TO RELATED APPLICATIONS

This application is a § 371 national stage entry of International Application No. PCT/EP2018/068989, filed Jul. 12, 2018, which claims priority of European National Application No. 17181503.8, filed Jul. 14, 2017, the entire contents of which are incorporated herein by reference.

SEQUENCE LISTING

The instant application contains a Sequence Listing which has been submitted electronically in ASCII format and is hereby incorporated by reference in its entirety. Said ASCII copy, created on Mar. 23, 2020, is named H2614-00101 RevisedSequenceList.txt and is 1,217,744 bytes in size.

FIELD OF THE INVENTION

The Invention relates to a genetically modified bacterial cell capable of improved iron-sulfur cluster delivery, characterized by a modified gene encoding a mutant Iron Sulfur Cluster Regulator (IscR) as well as one or more transgenes encoding polypeptides that enhance the biosynthesis of either biotin, lipoic acid or thiamine. The invention further relates to a method for producing either biotin, lipoic acid or thiamine using the genetically modified bacterium of the invention; as well as the use of the genetically modified bacterial cell for either biotin, lipoic acid or thiamine production.

BACKGROUND OF THE INVENTION

Biotin (also known as vitamin B7 or vitamin H), and thiamine (also known as vitamin B1), are essential dietary vitamins for humans, because in common with other metazoans, they cannot produce biotin or thiamine. Lipoic acid (LA) is a sulfur-containing, vitamin-like antioxidant and is synthesized in small amounts in bacteria, plants and animals. All three are widely used as dietary supplements. The production of these vitamin or vitamin-like compounds currently relies on chemical synthesis, which is costly. Biosynthetic methods for their manufacture would provide an alternative, more cost effective means for meeting current and future needs.

Biotin is an essential cofactor for enzymes catalyzing certain carboxylation reactions, such as acetyl-CoA carboxylase (ACC). ACC, which is present in all life forms, produces malonyl-CoA, a key building block for fatty acid biosynthesis. In nature, biotin is synthesized by a linear pathway involving the fatty acid biosynthetic pathway. The initial substrate of biotin synthesis in *Escherichia coli* (*E. coli*) is malonyl-ACP, which is also the starting metabolite for fatty acid synthesis. Prior to entering the fatty acid cycle, malonyl-ACP is masked by the SAM (S-adenosylmethionine)-dependent methyltransferase, BioC, thereby generating a malonyl-ACP methyl ester. Subsequently, two rounds of fatty acid chain elongation yields the molecule pimeloyl-ester-ACP. Hydrolysis of the O-methyl group of the pimeloyl-ester-ACP by a dedicated esterase, BioH, allows this molecule to exit the fatty acid elongation cycle. Subsequently, the intermediate, pimeloyl-ester-ACP, is converted to biotin via a biotin-specific pathway (FIG. 1A). In this pathway, BioF catalyzes the PLP-dependent decarboxylative aldol condensation of pimeloyl-ACP with alanine to yield KAPA (8-Amino-7-oxononanoate). BioA (and BioK) catalyzes the PLP-dependent transamination of KAPA to yield DAPA (7,8-diaminopelargonate), where the donor is SAM; with the by-product S-adenosyl-oxomethionine. BioD catalyzes the ATP-driven carboxylation and ring closure of DAPA to form the thiophane ring in desthiobiotin (DTB). The final step in the biotin synthesis pathway is one of the most complex reactions known, since it involves the introduction of a sulfur bridge between two hydrocarbons by BioB (biotin synthase), to yield biotin. BioB is an S-adenosyl-L-methionine (SAM or AdoMet) radical enzyme, which is found as a dimer; and comprises two iron-sulfur clusters: $[2Fe-2S]^{2+}$ and $[4Fe-4S]^{2+}$ in its active site. The sulfur atom, needed to create the thiophane ring in DTB, is believed to be recruited from the $[2Fe-2S]^{2+}$ cluster in BioB. As a consequence, the iron-sulfur cluster in the BioB dimer consumed in DTB synthesis is thought to be regenerated after each round of catalysis.

Lipoic acid (LA), in addition to being a potent scavenger of reactive oxygen species, and thus an important antioxidant, is also a co-factor for α-keto acid dehydrogenases. LA is synthesized de novo from an intermediate in fatty acid metabolism (FIG. 2). Three enzymes participating in LA synthesis in *E. coli* are LplA (lipoate-protein ligase), LipB (octanoyl protein ACP carrier protein: protein transferase), and LipA (lipoic acid synthase). LplA, encoded by the lplA gene, can catalyze the conjugation of exogenous octanoic acid to the unilpoylated-apo-lipoyl domain of the E2 subunit of a target enzyme in an ATP-dependent manner. LipB, encoded by the lipB gene, can catalyze the transfer of an octanoyl residue from ACP to the apo-lipoyl domain of the E2 subunit of a target enzyme. An AceF gene, encodes the lipoyl domain of the E2 subunit of pyruvate dehydrogenase. LipA, encoded by the lipA gene, is responsible for the formation of two C—S bonds. The LipA-driven reaction requires iron-sulfur clusters (4Fe-4S) and SAM (produced by the metK gene) in order to perform its function. Lipoic acid is mainly found in the cell as a protein-bound lipoamide moiety in a number of multi-enzyme complexes.

Thiamine biosynthesis has been characterized in bacteria, some protozoans, plants, and fungi. The thiazole and pyrimidine moieties of thiamine are synthesized separately (FIG. 3). The pyrimidine moiety, 4-amino-5-hydroxymethyl-2-methylpyrimidine phosphate (HMP-P), is derived from 5-aminoimidazole ribotide (AIR), an intermediate in the de novo purine biosynthetic pathway. In Gram-negative bacteria, conversion of AIR to HMP-P is catalyzed in a radical S-adenosyl-L-methionine (SAM)-dependent reaction by the thiC gene product, HMP-P synthase, which binds 1 [4Fe-4S] cluster per subunit.

HMP-P is then phosphorylated to HMP-PP by ThiD kinase prior to coupling with the thiazole unit. The thiazole moiety, 5-(2-hydroxyethyl)-4-methylthiazole phosphate (HET-P), is derived from L-tyrosine and 1-deoxy-D-xylulose phosphate (DXP) and cysteine; where the sulfur atom likely derives from L-cysteine. Tyrosine lyase, encoded by the thiH gene, binds 1 [4Fe-4S] cluster per subunit, and catalyzes the radical-mediated cleavage of tyrosine to 2-iminoacetate and 4-cresol. Synthesis of the thiazole moiety requires expression of at least five genes thiF, thiS, thiG, thiH and thiI.

The pyrimidine and thiazole moieties are then combined to form TMP by the action of thiamine-phosphate synthase (EC 2.5.1.3) encoded by thiE. Thus TMP is the first product of all known thiamine biosynthetic pathways. In *E. coli* and other Enterobacteriaceae, TMP may be phosphorylated to the cofactor TPP by a thiamine-phosphate kinase (EC 2.7.4.16) encoded by thiL in the presence of ATP. Bacterial strains comprising a transgene expressing a thiamine monophosphate phosphatase (E.C 3.1.3.-) can convert TMP to thiamine and thereby enhance thiamine production.

The use of bacterial-based cell factories is a potential route for the biosynthetic production of biotin, lipoic acid and thiamine. The advantages of recombinant *E. coli* as a cell factory for production of bio-products are widely recognized due to the fact that: (1) it has unparalleled fast growth kinetics; with a doubling time of about 20 minutes when cultivated in glucose-salts media and under optimal environmental conditions, (ii) it easily achieves a high cell density; where the theoretical density limit of an *E. coli* liquid culture is estimated to be about 200 g dry cell weight/l or roughly $1 \times 10^{13}$ viable bacteria/mL. Additionally, there are many molecular tools and protocols at hand for genetic modification of *E. coli*; as well as being an organism that is amenable to the expression of heterologous proteins; both of which may be essential for obtaining high-level production of desired bio-products.

In *E. coli*, the biotin operon structure is spilt into bioA and bioBFCD under the control of overlapping promoters on opposite strands (bioO locus), while bioH is located elsewhere on the *E. coli* chromosome. Expression of the biotin operon is down-regulated by a biotin-bound repressor (BirA); which binds to an operator in the biotin operon. BirA also functions as a biotin ligase, transferring biotin to cellular carboxylases. The switch in BirA function from biotin ligase to transcriptional repressor is regulated by the respective intracellular biotin and apo-carboxylase pools. Over-expression of the biotin operon (bioA and bioBFCD) in *E. coli* was reported to be inhibitory for growth (Ifuku, O. et al., 1995). Since the cause of this inhibition was unknown, this creates a stumbling block to enhancing biotin synthesis.

In general, there exists a need to identify the bottlenecks in these complex biosynthetic pathways such as to facilitate the production of biotin, lipoic acid and thiamine in bacterial-based cell factories (e.g. *E. coli*), that are tailor-made to overcome the diversity of factors that may limit their ability to both grow and produce elevated levels of their respective pathway enzymes.

SUMMARY OF THE INVENTION

According to a first embodiment, the invention provides a genetically modified bacterium for enhanced production of any one of biotin, lipoic acid or thiamine; wherein said bacterium comprises:
a genetically modified endogenous iscR gene encoding a mutant IscR polypeptide, wherein the amino acid sequence of said mutant IscR polypeptide has at least 80% sequence identity to SEQ ID No: 2, 4, 6, 8, 10, 12 and 14, and wherein the amino acid sequence has at least one amino acid substitution selected from the group consisting of:
L15X, C92X, C98X, C104X, and H107X; wherein X is any amino acid other than the corresponding amino acid residue in SEQ ID No 2, 4, 6, 8, 10, 12 and 14, and
a at least one transgene encoding a polypeptide selected from among:
a polypeptide having biotin synthase activity (EC 2.8.1.6) for enhanced biotin production,
a polypeptide having lipoic acid synthase activity (EC 2.8.1.8) for enhanced lipoic acid production,
a polypeptide having HMP-P synthase activity (EC 4.1.99.17) for enhanced thiamine production, and
a polypeptide having tyrosine lyase activity (EC 4.1.99.19) for enhanced thiamine production.

Preferably, the at least one amino acid substitution in said mutant IscR polypeptide is selected from the group consisting of:
L15X, wherein X is any one of F, Y, M and W;
C92X, wherein X is any one of Y, A, V, I, G, L, M, F and W;
C98X, wherein X is any one of A, V, I, G, L, F and W;
C104X, wherein X is any one of A V, I, G, L, F and W; and
H107X; wherein X, is any one of A, Y, M, F, W, V, I, G, and L.

The genetically modified bacterium for enhanced production of biotin according to the invention that comprises one transgene encoding a polypeptide having biotin synthase activity (EC 2.8.1.6) may further comprise additional transgenes encoding one or more polypeptides selected from the group consisting of:
a polypeptide having SAM (S-adenosylmethionine)-dependent methyltransferase activity (BioC; EC 2.1.1.197);
a polypeptide having 7-keto-8-aminopelargonic acid (KAPA) synthase activity (BioF; EC 2.3.1.47);
a polypeptide having 7,8-Diaminopelargonic Add (DAPA) Synthase activity (BioA; EC:2.6.1.62) or having L-lysine:8-amino-7-oxononanoate aminotransferase activity (BioK: EC:2.6.1.105);
a polypeptide having Dethiobiotin (DTB) Synthetase activity (BioD; EC 6.3.3.3), and
a polypeptide having Pimeloyl-[acyl-carrier protein] methyl ester esterase activity (BioH; EC 3.1.1.85) or a polypeptide having 6-carboxyhexanoate-CoA ligase activity (BioW; EC 6.2.1.14).

Preferably, the genetically modified bacterium for enhanced production of biotin according to the invention that comprises one transgene encoding a polypeptide having biotin synthase activity (EC 2.8.1.6) further comprises additional transgenes encoding polypeptides having SAM (S-adenosylmethionine)-dependent methyltransferase activity (BioC; EC 2.1.1.197); 7-keto-8-aminopelargonic acid (KAPA) synthase activity (BioF; EC 2.3.1.47); and 7,8-Diaminopelargonic Add (DAPA) Synthase activity (BioA; EC:2.6.1.62).

The genetically modified bacterium for enhanced production of lipoic acid according to the invention that comprises one transgene encoding a polypeptide having lipoic acid synthase activity (EC 2.8.1.8) may further comprise additional transgenes encoding one or more polypeptides selected from the group consisting of:
a polypeptide having octanoyltransferase activity (EC 2.3.1.181), and
a polypeptide comprising the dihydrolilpoyllysine-residue acetyltransferase component of pyruvate dehydrogenase activity (EC 2.3.1.12), and
a polypeptide having lipoate-protein ligase A (LplA; EC:6.3.1.20).

The genetically modified bacterium for enhanced production of thiamine according to the invention that comprises one transgene encoding a ThiC polypeptide having HMP-P synthase activity (EC 4.1.99.17), and/or one transgene encoding a ThiH polypeptide having tyrosine lyase activity (EC 4.1.99.19), may further comprise additional transgenes encoding one or more polypeptides selected from the group consisting of:

a ThiF polypeptide having ThiS adenylyltransferase (EC 2.7.7.73) activity;

a ThiE polypeptide having thiamine phosphate synthase (EC 2.5.1.3) activity;

a ThiG polypeptide having thiazole synthase (E.C. 2.8.1.10) activity;

a ThiD polypeptide having phosphohydroxymethylpyrimidine kinase (EC 2.7.4.7) activity;

a ThiS polypeptide having sulfur-carrier protein activity;

a polypeptide having thiamine mono-phosphate phosphatase (E.C. 3.1.3.-) activity; and a ThiO polypeptide having glycine oxidase (EC 1.4.3.19) activity; and optionally, an additional transgene encoding:

a ThiM polypeptide having hydroxyethylthiazole kinase activity (2.7.1.50).

Preferably, the genetically modified bacterial cell comprises transgenes encoding the polypeptides: ThiC (encoded by a thiC gene); ThiD (encoded by a thiD gene), ThiE (encoded by a thiE gene), ThiF (encoded by a thiF gene), sulfur-carrier protein (encoded by a thiS gene), ThiG (encoded by a thiG gene), TMP phosphatase (encoded by a TMP phosphatase gene); and either ThiH (encoded by a thiH gene) or ThiO (encoded by a thiO gene). According to the embodiment, the cells may further comprise a transgene encoding the enzyme ThiM ((encoded by a thiM gene).

Preferably each of the at least one transgene and the one or more additional transgenes in the genetically modified bacterium of the invention is operably linked to a constitutive promoter (where the promoter may be operably linked to an operon comprising the transgenes).

The genetically modified bacterium of the invention is preferably a species of a genus selected from the group consisting of Escherichia, Bacillus, Brevibacterium, Burkholderia, Campylobacter, Corynebacterium, Serratia, Lactobacillus, Lactococcus, Acinetobacter, Acetobacter and Pseudomonas; more preferably a species of Escherichia or Corynebacterium; for example Escherichia coli or Corynebacterium glutamicum.

According to a second embodiment, the invention provides a method for producing biotin, comprising the steps of:

introducing a genetically modified bacterium comprising a transgene encoding a polypeptide having biotin synthase activity (EC 2.8.1.6) according to the invention into a growth medium to produce a culture;

cultivating the culture; and recovering biotin produced by said culture, and optionally purifying the recovered biotin.

According to a third embodiment, the invention provides a method for producing lipoic acid comprising the steps of:

Introducing a genetically modified bacterium comprising one transgene encoding a polypeptide having lipoic acid synthase activity (EC 2.8.1.8) according to the invention into a growth medium to produce a culture;

cultivating the culture; and recovering lipoic acid produced by said culture, and optionally purifying the recovered lipoic acid.

According to a fourth embodiment, the invention provides a method for producing thiamine comprising the steps of:

introducing a genetically modified bacterium a transgene encoding a polypeptide having HMP-P synthase activity (EC 4.1.99.17), and/or a transgene encoding a polypeptide having tyrosine lyase activity (EC 4.1.99.19) according to the invention into a growth medium to produce a culture;

cultivating the culture; and recovering thiamine produced by said culture, and optionally purifying the recovered thiamine.

Preferably the growth medium used in the method for producing any one of biotin, lipoic acid and thiamine, comprises a carbon source selected from glucose, maltose, galactose, fructose, sucrose, arabinose, xylose, raffinose, mannose, lactose, or any combination thereof.

According to a fourth embodiment, the invention provides for the use of a genetically modified gene encoding a mutant iscR polypeptide to enhance biotin production in a bacterial cell expressing a transgene encoding a biotin synthase, wherein the amino acid sequence of the a mutant IscR polypeptide has at least 80% sequence identity to SEQ ID No.: 2, 4, 6, 8, 10, 12 and 14; and wherein the amino acid sequence has at least one amino acid substitution selected from the group consisting of: L15X, Cys92X, Cys98X, Cys104X, and His107X; wherein X is any amino acid other than the corresponding amino acid residue in SEQ ID No.: 2, 4, 6, 8, 10, 12 and 14.

According to a fourth embodiment, the invention provides for the use of a genetically modified gene encoding a mutant iscR polypeptide to enhance production of any one of biotin, lipoic acid or thiamine in a bacterium, wherein said bacterium comprises and expresses at least one transgene encoding a polypeptide selected from among:

a polypeptide having biotin synthase activity (EC 2.8.1.6), a polypeptide having lipoic acid synthase activity (EC 2.8.1.8), a polypeptide having HMP-P synthase activity (EC 4.1.99.17), and a polypeptide having tyrosine lyase activity (EC 4.1.99.19), wherein said genetically modified gene is an endogenous iscR gene encoding a mutant IscR polypeptide, wherein the amino acid sequence of said mutant IscR polypeptide has at least 80% sequence identity to SEQ ID No: 2, 4, 6, 8, 10, 12 and 14, and wherein the amino acid sequence has at least one amino acid substitution selected from the group consisting of: L15X, Cys92X, Cys98X, Cys104X, and His107X; wherein X is any amino acid other than the corresponding amino acid residue in SEQ ID No 2, 4, 6, 8, 10, 12 and 14.

According to a fifth embodiment, the invention provides for the use of a genetically modified bacterium according to the invention for enhanced production of biotin, lipoic acid or thiamine.

According to a sixth embodiment, the invention provides a genetically modified bacterium according to the invention for enhanced production of any one of biotin, lipoic acid or thiamine, wherein the bacterium further comprises one or more genes encoding polypeptides capable of mediating enhanced electron transfer from the electron donor NADPH to a $[4Fe-4S]^{2+}$ cluster of a SAM-radical iron-sulfur cluster enzyme; for example polypeptides of a flavodoxin/ferredoxin reductase and flavodoxin reduction system or a Pyruvate-flavodoxin/ferredoxin oxidoreductase system.

Figure 13:
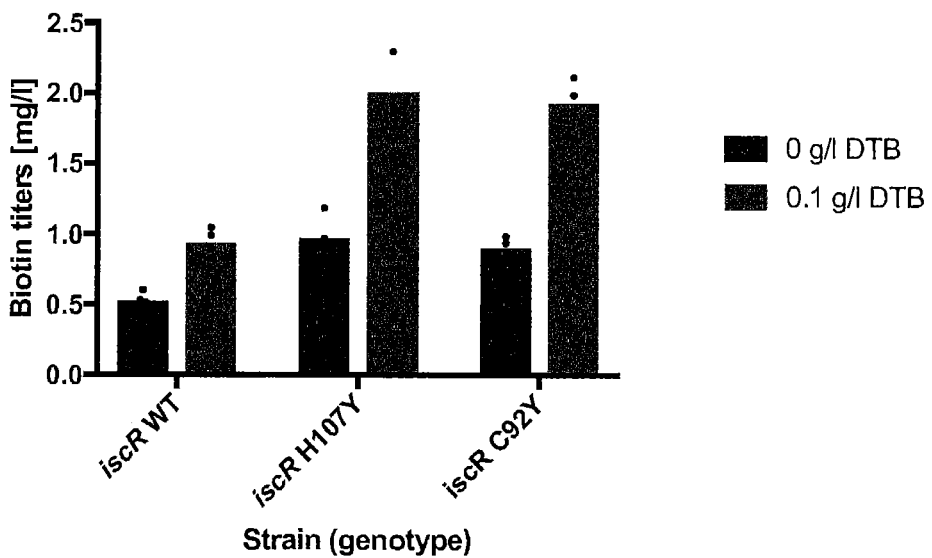

FIG. 13 Bar diagram showing biotin production by an *E. coli* ΔbioA ΔbioBFCD strain comprising a biotin-operon plasmid and either of the following genomic variants of iscR: wild type (iscR WT), mutant iscR H107Y (encoding a histidine to tyrosine substitution at position 107) or mutant (iscR C92Y) encoding a cysteine to tyrosine substitution at position 92. Biological quadruplicates of each strain were cultured in mMOPS with 10 µg/mL tetracycline with and without providing 0.1 g/L desthiobiotin (DTB) as substrate. The strains were grown in deep well plates for 24 hours at 37 degrees C. with 275 rpm, after which biotin production was evaluated using a growth based bioassay. Bars illustrate the mean biotin production value (height) and whether DTB was fed or not (shade of gray), black dots shows biotin production from individual replicates.

Figure 14:
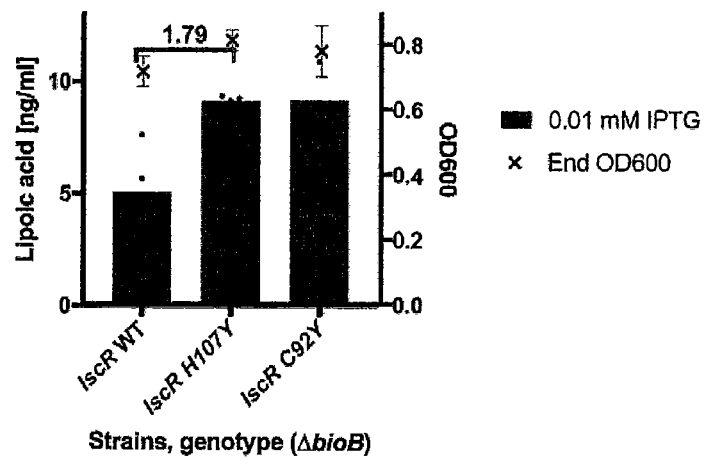

FIG. 14 Bar diagram showing lipoic acid production (grey bars) and End (final) $OD_{600}$ after 24 hours of production (crosses) of two different iscR mutant strains expressing mutant IscR having amino acid mutations (BS1375, C92Y) and (BS1353, H107Y) and a control strain (BS1011, IscR WT) (see Table 1 for strains) in 3 biological replicates each comprising a plasmid expressing IPTG inducible lipA (pBS993, see Table 4). Strains were grown in 400 µL mMOPS with 100 µg/mL ampicillin, 0.1 mM biotin, 0.6 g/l octanoic acid and 0.01 mM IPTG for 24 hours at 37° C. with 275 rpm shake. Bars illustrate the mean lipoic acid production value (height), black dots show lipoic acid production from individual replicate cultures. The average lipoic acid production can be seen to increase 1.79-fold even though the end $OD_{600}$ stays the same.

Figure 15:
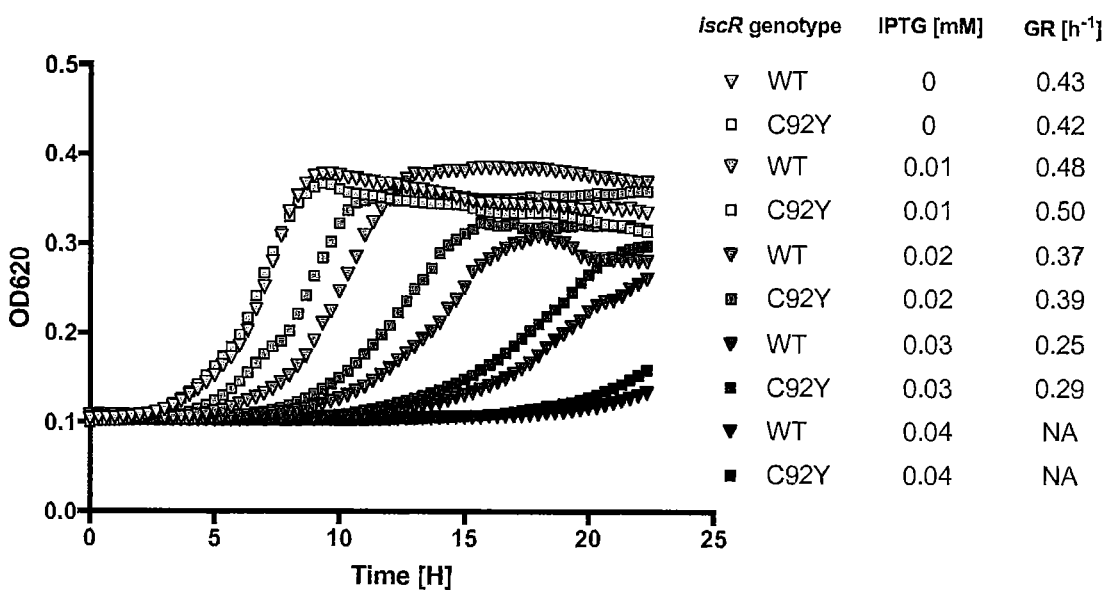

FIG. 15 Graphical presentation of the cell density (measured at $OD_{620}$), measured over time, of the reference strain (*E. coli* BW25113) ΔlipA (WT, triangles); and the ΔlipA strain with a mutant iscR (C92Y) (C92Y, squares) both comprising an IPTG inducible lipA expression plasmid (pBS1037). $OD_{620}$ was measured using a Multiskan, for 6 biological strain replicates grown in 200 µL mMOPS with 0.6 g/L octanoic acid, 100 µg/mL ampicillin and 0 to 0.04 mM IPTG (increasing darkness of grey shade). Respective growth rates (GR) are shown to the right.

Figure 16:
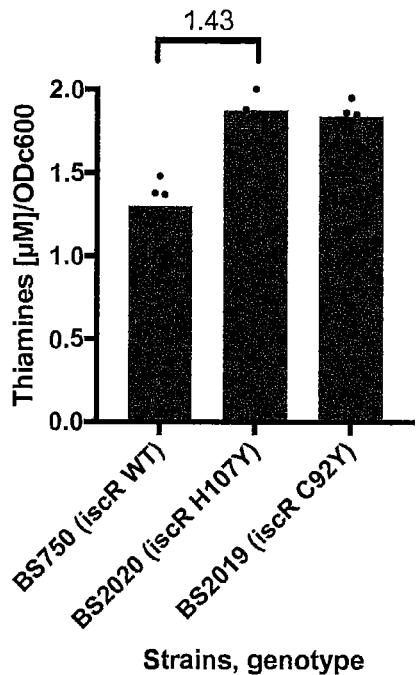

FIG. 16 Bar diagram showing thiamine production of two different iscR mutant strains expressing mutant IscR having amino acid mutations (BS2019, C92Y) and (BS2020, H107Y) and an *E. coli* BW25113 ΔthiP, thiL* strain (BS750, Ref) (see Table 5 for strains) in 4 biological replicates each comprising a plasmid expressing the entire thiamine pathway genes, thiCEFSGHMD (pBS140). Strains were grown in 400 µL mMOPS with 50 µg/mL kanamycin for 24 hours at 37° C. with 275 rpm shake. Bars illustrate the mean thiamine production value (height) in the supernatant as measured by thiochrome assay (including thiamine, TMP and TPP) corrected for end $OD_{600}$, black dots show thiamine production from individual replicate cultures. The OD normalized titer, can be seen to be improved 1.43-fold in mutant strains (BS2019 and BS2020) compared to the reference strain (BS750).

Figure 17:
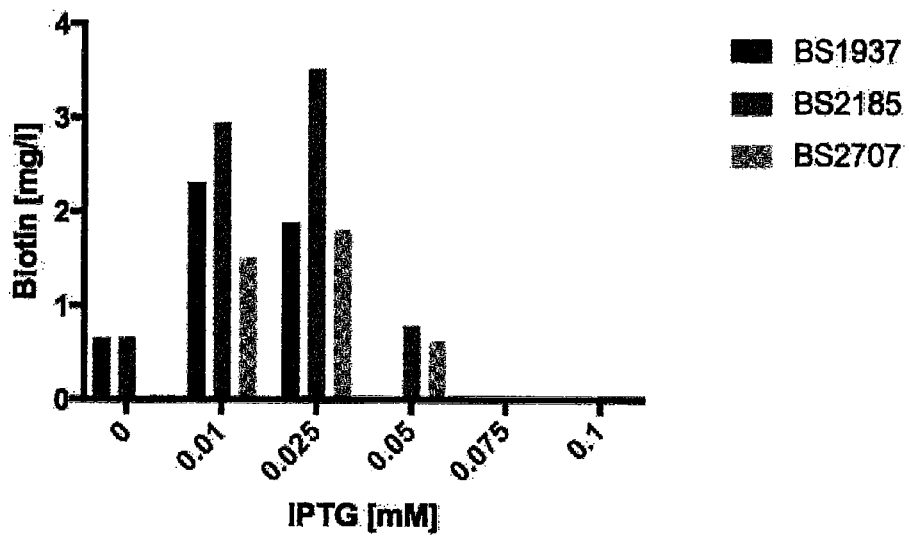

FIG. 17 Bar diagram showing biotin production by *E. coli* ΔbioABFCD iscR H107Y (encoding a histidine to tyrosine substitution at position 107) strains comprising IPTG-inducible BioB overexpression plasmid pBS679 alone (BS1937) or in addition pBS1112 (BS2185) with constitutive overexpression of FldA-Fpr or pBS1054 (BS2707) with constitutive overexpression of GFP. Each strain was cultured in mMOPS with 100 µg/ml ampicillin, 0.1 g/L desthiobiotin (DTB) as substrate and either 0, 0.01, 0.025, 0.05, 0.075 or 0.1 mM IPTG. The medium for BS2185 and BS2707 was identical except for the inclusion of 50 µg/ml kanamycin. The strains were grown in deep well plates for 24 hours at 37 degrees C. with 275 rpm, after which biotin production was evaluated using a growth based bioassay. Bars illustrate biotin production value (height) by the respective strains: BS1937 (black bars); BS2185 (grey bars); and BS2707 (checkered grey bars).

Figure 18:
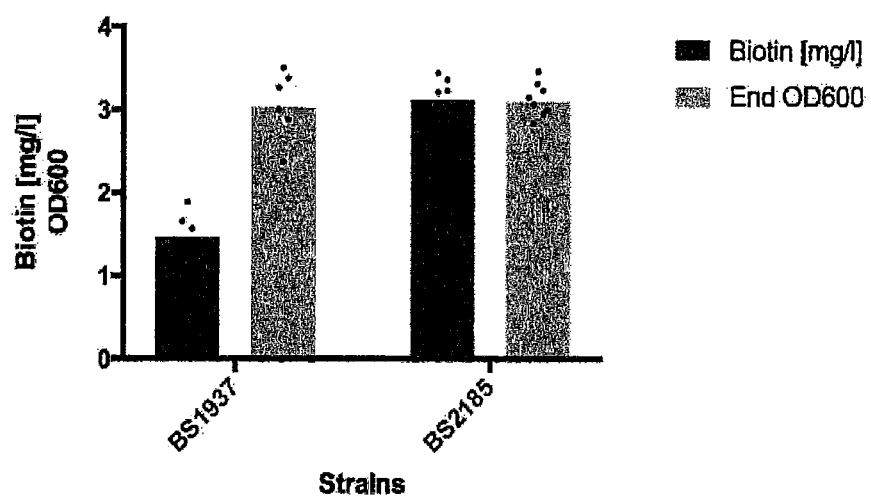

FIG. 18 Bar diagram showing biotin production by *E. coli* ΔbioABFCD iscR H107Y (encoding a histidine to tyrosine substitution at position 107) strains comprising IPTG-inducible BioB overexpression plasmid pBS679. BS2185 comprises in addition pBS1112 with constitutive overexpression of FldA-Fpr. BS1937 was cultured in mMOPS with 100 µg/ml ampicillin, 0.1 g/L desthiobiotin (DTB) as substrate and 0.025 mM IPTG induction. The medium for BS2185 was identical, but included in addition 50 µg/ml kanamycin. The strains were grown in deep well plates for 24 hours at 37 degrees C. with 275 rpm, after which biotin production was evaluated using a growth based bioassay. Dark grey bars illustrate the mean biotin production value (height) (BS1937 n=6 and BS2185 n=8) and light grey bars illustrate end $OD_{600}$. Black dots show biotin production and end $OD_{600}$ from individual replicates.

DEFINITIONS

Amino acid sequence identity: The term "sequence identity" as used herein, indicates a quantitative measure of the degree of homology between two amino acid sequences of substantially equal length. The two sequences to be compared must be aligned to give a best possible fit, by means of the insertion of gaps or alternatively, truncation at the ends of the protein sequences. The sequence identity can be calculated as ((Nref-Ndif)100)/(Nref), wherein Ndif is the total number of non-identical residues in the two sequences when aligned and wherein Nref is the number of residues in one of the sequences. Sequence identity calculations are preferably automated using the BLAST program e.g. the BLASTP program (Pearson W. R and D. J. Lipman (1988)) (www.ncbi.nlm.nih.gov/cgi-bin/BLAST). Multiple sequence alignment is performed with the sequence alignment method ClustalW with default parameters as described by Thompson J., et al 1994, available at http://www2.ebi.ac.uk/clustalw/.

Preferably, the numbers of substitutions, insertions, additions or deletions of one or more amino acid residues in the polypeptide as compared to its comparator polypeptide is limited, i.e. no more than 1, 2, 3, 4, 5, 6, 7, 8, 9, or 10 substitutions, no more than 1, 2, 3, 4, 5, 6, 7, 8, 9, or 10 insertions, no more than 1, 2, 3, 4, 5, 6, 7, 8, 9, or 10 additions, and no more than 1, 2, 3, 4, 5, 6, 7, 8, 9, or 10 deletions. Preferably the substitutions are conservative amino acid substitutions: limited to exchanges within members of group 1: Glycine, Alanine, Valine, Leucine, Isoleucine; group 2: Serine, Cysteine, Selenocysteine, Threonine, Methionine; group 3: proline; group 4: Phenylalanine, Tyrosine, Tryptophan; Group 5: Aspartate, Glutamate, Asparagine, Glutamine.

Amino acid abbreviations: Leucine (L), Cysteine (C), and Histidine (H).

Endogenous gene: is a gene in a bacterial cell genome that is homologous in origin to a host bacterium (i.e. a native gene of the host bacterium). The endogenous gene may be genetically modified using tools known in the art whereby the genetically modified endogenous gene encodes a mutant polypeptide whose amino acid sequence differs at one or more position from the polypeptide encoded by the parent endogenous gene from which it was derived.

Genome: is the genetic material present in a cell or organism; said genome comprising all of the information needed to build and maintain that cell or organism; and includes the genetic material in both chromosome(s) and plasmid(s) present within the cell or organism.

GFP: Green Fluorescent Protein.

gi number: (genInfo identifier) is a unique integer which identifies a particular sequence, independent of the database source, which is assigned by NCBI to all sequences processed into Entrez, including nucleotide sequences from DDBJ/EMBL/GenBank, protein sequences from SWISS-PROT, PIR and many others.

Isc pathway: Iron sulphur duster pathway; encoded by the isc operon including the iscR gene.

Multiskan: filter-based microplate photometer; for measuring absorbance from 96 or 384-well plate formats in the wavelength range of 340 to 850 nm, including 600-620 nm. Plates are incubated in the photometer at the selected temperature, of up to 50° C. The photometer is supplied by Thermo Scientific.

Native gene: endogenous gene in a bacterial cell genome, homologous to host bacterium.

Non-native promoter: in the context of a genetically modified bacterium of the present invention, is a promoter that is operably-linked to a gene or transgene in said cell, where said promoter would not be found operably-linked to said gene or transgene in a bacterial cell found in nature.

OD: Optical Density

Transgene: is an exogenous gene that has been introduced into the genome of a bacterium by means of genetic engineering. In the context of the present invention, said genome includes both chromosomal and episomal genetic elements.

DETAILED DESCRIPTION OF THE INVENTION

A common feature of the biosynthetic pathways for the synthesis of biotin, lipoic acid and thiamine, is the requirement for one or more SAM or AdoMet radical enzymes to catalyze complex radical-mediated molecular rearrangements. Biotin synthase, lipoic acid synthase, HMP-P synthase, and tyrosine lyase are the respective enzymes known to catalyze these essential steps in these pathways. The failure of earlier attempts to elevate biotin biosynthesis in E. coli by overexpression of the biotin operon, or even by using a mutant biotin operon insusceptible to feedback regulation by the BirA repressor, was due to a strong inhibition of growth (Ifuku, O. et al., 1995). In the absence of any evidence-based explanation for the observed growth inhibition; alternative approaches were needed to identify the cellular factors that may account for the toxicity of biotin synthase over-expression.

The solution to this problem, provided by the present invention, is shown to be equally applicable for enhancing the expression of biotin synthase, lipoic acid synthase, HMP-P synthase and tyrosine lyase in cells of a bacterial cell factory (for example E. coli). The approach pursued to solve this problem was to generate libraries of E. coli cells having evolved genomic diversity due to the accumulation of background mutations generated by imperfect error-correcting polymerases. Cells of such libraries were transformed with a plasmid comprising an IPTG-inducible bioB gene expression cassette. Candidate mutants were those cells in a library that were capable of growth in the presence of IPTG at a concentration sufficient to induce BioB expression toxicity in the parent E. coli strain from which the mutant cells were derived.

The genetic basis for the growth of the selected BioB-expressing mutant strains was established by whole genome sequencing. Surprisingly three of the strains were found to have mutations in the native Iron Sulfur Cluster Regulator gene (iscR); which encodes a pleiotropic transcription factor (IscR) [SEQ ID No.: 2]. Fe—S clusters are co-factors of many proteins and essential enzymes, endowing them with diverse biochemical abilities that are not solely required for the synthesis of S-containing compounds such as biotin, but also as sensors for redox- or iron-related stress conditions.

Figure 1:
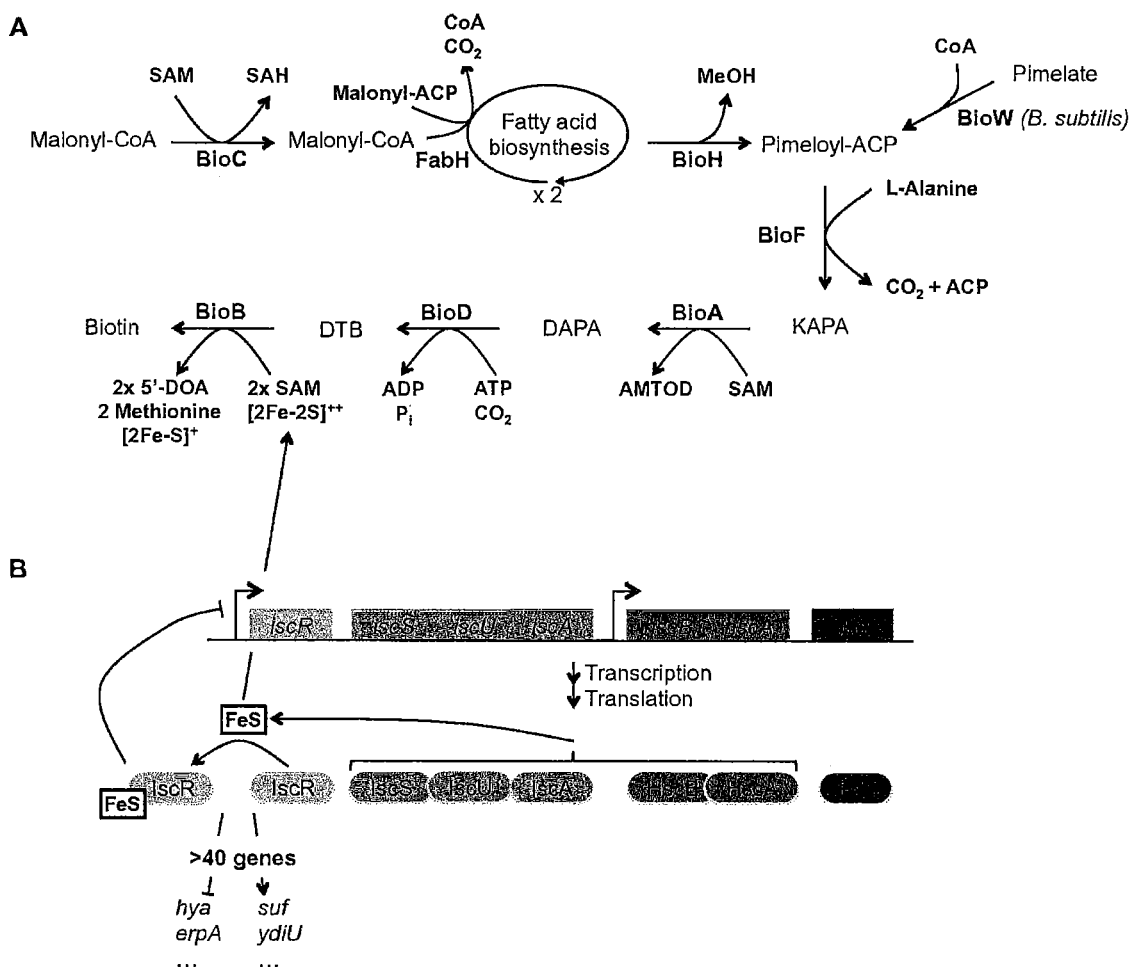
FIG. 1 Cartoon showing A) Intermediates of the biotin pathway in bacteria and the respective enzymatic steps leading to synthesis of biotin. SAM: S-adenosyl-L-methionine, SAH: S-Adenosyl-L-homocysteine, CoA: coenzyme A, ACP: Acyl Carrier Protein, KAPA: 7-keto-8-aminopelargonic acid, AMTOD: S-adenosyl-2-oxo-4-thiomethylbutyrate, DAPA: 7,8-Diaminopelargonic Acid, DTB: desthiobiotin, 5'DOA: 5'-deoxyadenosine. B) isc-operon structure and role in Fe3 S-cluster formation as well as the regulatory mechanism of IscR. The isc operon comprises an iscR gene encoding the IscR that regulates expression of the genes: iscS (cysteine desulphurase), iscU (scaffold), iscA (A-type protein), HscB (Dnaj-like co-chaperone), HscA (DnaK-like chaperone), and fdx (ferredoxin). IscR also regulates >40 genes including the genes hyaA, ydiU, erpA, and sufA.

IscR exists in two states, either as an Fe—S cluster holo-protein, or as the apo-protein without the Fe—S cluster. Assembly of the Fe—S cluster of IscR is catalyzed by the Isc pathway encoded by the isc operon. The isc operon encodes firstly the regulator (IscR), followed by a cysteine desulphurase (IscS), a scaffold (IscU), an A-type protein (IscA), a Dnaj-like co-chaperone (HscB), a DnaK-like chaperone (HscA) and a ferredoxin (Fdx). In addition to being essential for the assembly of the IscR holoenzyme, the Isc pathway is the primary pathway for Fe—S cluster biogenesis in E. coli (FIG. 1B).

The ratio between the two forms of IscR is determined by the cellular level of [2Fe-2S] clusters, which in turn is influenced by several factors including iron- and oxygen levels (Py, B. & Barras, 2010). Under iron-rich conditions, IscR exists mainly as the holoenzyme, which then acts as a transcriptional repressor of the isc operon. However, under iron-low conditions (low level of [2Fe-2S] clusters), IscR returns to its apo-protein state, allowing transcription of the isc operon. In its apo-protein state, IscR serves as an activator of the sufABCDSE operon, which catalyzes Fe—S cluster biogenesis under oxidative stress.

In addition to regulating expression of the two Fe—S-cluster assembly systems in E. coli, IscR regulates >40 genes involved in diverse mechanisms of action such as oxidative stress mechanisms (e.g. sodA), specific and global regulators (e.g. yqjI and soxS), amino acid biosynthesis (e.g argE) and a range of genes with unknown functions. The role of IscR is further complicated by the fact that the IscR regulatory landscape changes between aerobic and anaerobic conditions (Martin, and Imlay, 2012; Giel et al., 2006).

In view of the homeostatic role of IscR; and its role in global gene regulation; the consequences of any modification of its regulatory properties are unpredictable and probably profound for cellular metabolism. Furthermore, cellular conditions where Fe—S cluster biogenesis is increased, due to elevated expression of both the sulfur formation (suf) and isc pathways creates the risk that the accumulated Fe—S clusters generate peroxide radicals by fenton reactions.

Figure 10:
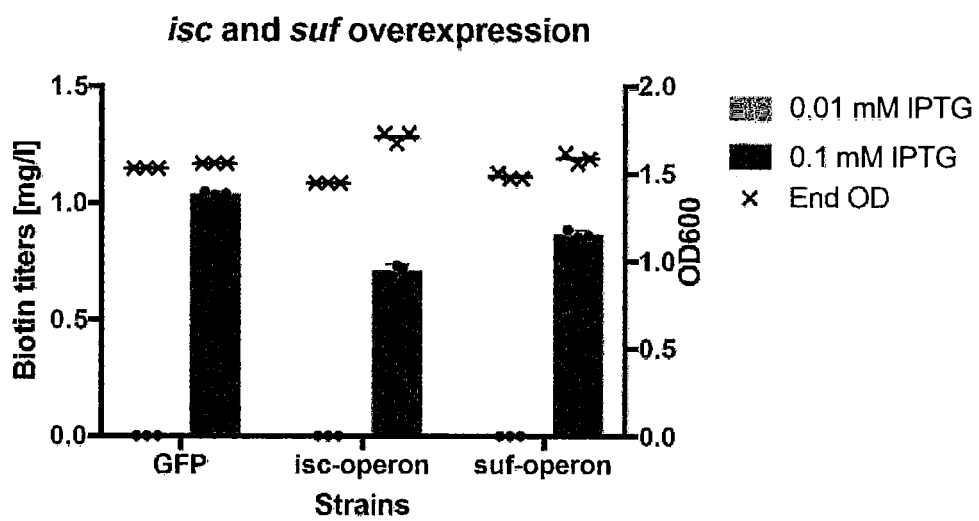
FIG. 10 Bar diagram showing biotin production of an *E. coli* strain comprising an IPTG-inducible bioB expression plasmid and either a plasmid comprising an isc-operon (iscSUA-hscBA-fdx, corresponding to a native *E. coli* isc operon structure lacking iscR gene) or the *E. coli* suf-operon (sufABCDSE) operably linked to a strong ribosomal binding site (RBS) and a T5 LacO repressed promoter from a medium copy number plasmid (p15A ori) or a control plasmid. The control plasmid comprised an IPTG-inducible gene encoding GFP instead of the suf- or isc-operon. Biological triplicates of each strain were cultured in mMOPS with 100 μg/mL ampicillin and 50 μg/mL spectinomycin under low (0.01 mM IPTG) and high (0.1 mM IPTG) induction and providing 0.1 g/L (DTB) as substrate. The strains were grown in deep well plates for 24 hours at 37 degrees C. with 275 rpm, after which biotin production was evaluated using a growth based bioassay. Bars illustrate the mean biotin production value (height) and IPTG induction level (gray shade), black dots shows biotin production from individual replicates and the crosses show end-point (end) cell density of each strain, measured as $OD_{600}$. Note that none of the strains produced detectable levels of biotin when induced with 0.01 mM IPTG.

In this light, it was highly unexpected that IscR should be found so important for the activity and toxicity of cellular BioB, as demonstrated by the three isolated individual mutants. Furthermore, the impact of the mutant IscR protein on biotin biosynthesis was unexpected, since over-expression of the isc operon or suf operons giving an increased capacity to synthesize and assemble Fe—S clusters was not found to enhance biotin production in cells over-expressing bioB (see example 1, FIG. 10). Further, removal of cellular iscR regulation by knock-out of the iscR gene also failed to enhance biotin production in the cell (see example 1, FIG. 12).

Figure 8:
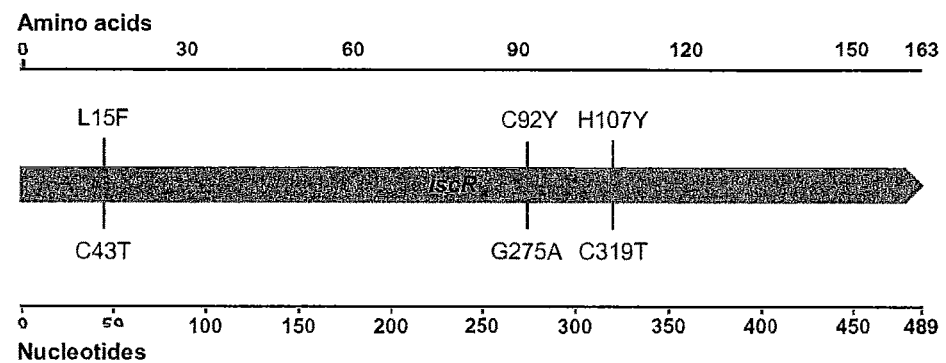
FIG. 8 Cartoon showing the IscR coding sequence annotated to show the location of the nucleotide and amino acid sequence mutations in the IscR genes of the identified mutant strains.

The three different mutations in the IscR protein that eliminated the toxicity of BioB expression in the mutant cells, were single amino acid substitutions of the amino acids L15 [SEQ ID No.: 16], C92 [SEQ ID No.: 18] and H107 [SEQ ID No.: 20] (FIG. 8). Two of the three mutations correspond precisely to those residues in IscR, each of which is known to be essential for the formation of the IscR holo-protein. IscR, as seen in *E. coli*, has an unusual Fe—S cluster ligation mechanism, whereby the residues essential for Fe—S cluster ligation are C92, C98, and C104, as well as H107. This atypical ligation may confer a lower stability of holoenzyme state of IscR relative to other Fe—S proteins that in turn accounts for the switch to the apo-protein state during low Fe—S conditions (Fleischhacker et al., 2012).

While not wishing to be bound by theory, this suggests that homeostatic control of Fe—S cluster biogenesis and global gene regulation required for cell growth are uniquely preserved in cells expressing a mutant iscR gene of the invention, while facilitating the assembly of iron-sulfur cluster containing enzymes (biotin synthase, lipoic acid synthase, HMP-P synthase and tyrosine lyase) even during their over-expression.

In summary, the inventors have identified a mutant iscR gene encoding a mutant IscR protein, characterized by the lack of one or more of amino acid residues required for ligation of Fe—S clusters, such that the expressed mutant IscR protein exists solely in the apo-protein form. Synthesis of iron-sulfur cluster containing enzymes is shown to constitute a significant bottleneck in efforts to enhance production of either biotin, lipoic acid or thiamine in bacteria. The solution to this problem, as provided by the present invention, is facilitated by over-expression of these enzymes in a cell factory comprising a gene encoding a mutant IscR protein that exists in the apo-protein state. The various embodiments of the invention are described in more detail below.

I A Genetically Modified Bacterial Cell for Production of Biotin

The present invention provides a genetically modified bacterial cell capable of producing enhanced levels of biotin. The bacterial cell is genetically modified to express a mutant IscR in substitution for a wild type IscR, as well as comprising a transgene encoding a biotin synthase (biotin synthase having EC 2.8.1.6). Optionally, the genetically modified bacterial cell may further comprise one or more additional transgenes encoding polypeptides that catalyze additional steps in the biotin pathway (FIG. 1A). An increase in the levels of those polypeptides that catalyze steps in the biotin pathway enhances the synthesis of both intermediates in the biotin pathway, and the end product of the pathway (biotin) in the bacterial cell.

The mutant IscR polypeptide, expressed by the genetically modified bacterial cell, is derived from a wild-type member of a family of IscR polypeptides characterized by a polypeptide backbone (apo-protein). The amino acid sequence of a wild-type member of a family of IscR polypeptides has at least 70, 75, 80, 85, 90, 95, 96, 98, 100% amino acid sequence identity to a sequence selected from any one of: SEQ ID No.: 2, 4, 6, 8, 10, 12 and 14. The amino acid sequence of the mutant IscR polypeptide according to the invention differs from the amino acid sequence of the corresponding wild-type IscR polypeptide from which it was derived by at least one amino acid substitution; wherein said substitution is selected from L15X, C92X, C98X, C104X, and H107X; wherein X, the substituting amino acid, is any amino acid other than the amino acid found at the corresponding position in the wild type IscR from which the mutant was derived.

In alternative embodiments, the amino acid substitution in the mutant IscR is selected from either L15X, wherein X is any amino acid other than L, more preferably X is selected from phenylalanine (F), tyrosine (Y), methionine (M) and tryptophan (W); C92X, wherein X is any amino acid other than C, more preferably X is selected from tyrosine (Y), alanine (A), methionine (M), phenylalanine (F) and tryptophan (W); C98X, wherein X is any amino acid other than C, more preferably X is selected from alanine (A), valine (V), isoleucine (I), leucine (L), phenylalanine (F) and tryptophan (W); Cys104X, wherein X is any amino acid other than C, more preferably X is selected from alanine (A), valine (V), isoleucine (I), leucine (L), phenylalanine (F), and tryptophan (W); and His107X, wherein X is any amino acid other than H, more preferably X is selected from alanine (A), tyrosine (Y), valine (V), isoleucine (I), and leucine (L). For example, the amino acid substitution in the mutant IscR may be selected from among L15F, C92Y, C92A, C98A, Cys104A, H107Y, and H107A.

The mutant IscR expressed by the genetically modified bacterial cell of the invention (instead of a wild type IscR), is encoded by a genetically modified gene, located in the genome of the bacterial cell, either on the chromosome or on a self-replicating plasmid. The genetically modified iscR gene in the chromosome can be located in the genome at the same position of the wild-type iscR gene in the native genome. The genome of the genetically modified bacterial cell of the invention lacks a native wild type iscR gene, since the native wild type iscR gene is either deleted or directly substituted by the genetically modified iscR gene. The promoter driving expression of the genetically modified iscR gene may be the native promoter of the wild type iscR gene from which the genetically modified iscR gene was derived or replaced by. Alternatively, the promoter may be a heterologous constitutive or inducible promoter. When the promoter is a heterologous constitutive promoter, then a suitable promoter includes: apFab family [SEQ ID Nos.:230-232] while a suitable inducible promoter includes: pBad (arabinose inducible [SEQ ID No.:233] and LacI [SEQ ID No.:234]. Suitable terminators include members of the apFAB terminator family including [SEQ ID No.: 235-237].

A polypeptide having biotin synthase activity (EC 2.8.1.6) according to the invention is a polypeptide having biotin synthase activity catalyzing the conversion of destiobiotin (DTB) into biotin. The members of this family of biotin synthases are encoded by genes found in bacteria belonging to a wide range of genera. The amino acid sequence of the polypeptide having biotin synthase activity has at least 70, 75, 80, 85, 90, 95, 96, 98, 100% amino acid sequence identity to a sequence selected from any one of: SEQ ID No.: 22 (origin: *Escherichia coli*); SEQ ID No.: 27 (origin: *Candidatus Chloracidobacterium thermophilum* B); SEQ ID No.: 29 (origin: *Streptomyces lydicus*); SEQ ID No.: 31 (origin: *Paracoccus denitrificans*); SEQ ID No.: 33 (origin: *Paracoccus denitrificans* PD1222); SEQ ID No.: 35 (origin: *Agrobacterium vitis*); SEQ ID No.: 37 (origin: *Ruegeria pomeroyi*); SEQ ID No.: 39 (origin: *Agrobacterium fabrum*);

SEQ ID No.: 41 (origin: *Wolbachia* endosymbiont of *Cimex lectularius*); SEQ ID No.: 43 (origin: *Sphingomonas paudmobilis*); SEQ ID No.: 45 (origin: *Acidithiobacillus ferrivorans*); SEQ ID No.: 47 (origin: *Gallionella capsiferriformans*); SEQ ID No.: 49 (origin: *Ralstonia eutropha*); SEQ ID No.: 51 (origin: *Bordetella parapertussis*); SEQ ID No.: 53 (origin: *Pusillimonas* sp.); SEQ ID No.: 55 (origin: *Cenarchaeum symbiosum* sp.); SEQ ID No.: 57 (origin: *Alicydobacillus acidocaldarius* sp.); SEQ ID No.: 59 (origin: *Geobacillus thermoglucosidasius*); SEQ ID No.: 61 (origin: *Bacillus subtilis*); SEQ ID No.: 63 (origin: *Lysinibacillus sphaericus*); SEQ ID No.: 65 (origin: *Methylococcus capsulatus*); SEQ ID No.: 67 (origin: *Leclercia adecarboxylata*); SEQ ID No.: 69 (origin: *Chromohalobacter salexigens*); SEQ ID No.: 71, 73, 75, 77, 79, 81, 83, 85, 87 (origin: *Pseudomonas* spp).

The polypeptides that are encoded by the additional transgenes in the genetically modified bacterial cell, and whose activity serves to enhance the synthesis of both intermediates and products of the biotin pathway, are as follows:

a) a polypeptide having SAM (S-adenosylmethionine)-dependent methyltransferase activity (BioC; EC 2.1.1.197); such as a polypeptide with an amino acid sequence having 80, 85, 90, 95 or 100% sequence identity to SEQ ID No.:89;

b) a polypeptide having 7-keto-8-aminopelargonic acid (KAPA) synthase activity (BioF; EC 2.3.1.47), such as a polypeptide with an amino acid sequence having 80, 85, 90, 95 or 100% sequence identity to SEQ ID No.: 91;

c) a polypeptide having 7,8-Diaminopelargonic Acid (DAPA) Synthase activity (BioA; EC:2.6.1.62) such as a polypeptide with an amino acid sequence having 80, 85, 90, 95 or 100% sequence identity to SEQ ID No.: 93; or L-lysine:8-amino-7-oxononanoate aminotransferase (BioK; EC:2.6.1.105) such as a polypeptide with an amino acid sequence having 80, 85, 90, 95 or 100% sequence identity to SEQ ID No.: 97;

d) a polypeptide having Desthiobiotin (DTB) Synthetase activity (BioD; E.C 6.3.3.3), such as a polypeptide with an amino acid sequence having 80, 85, 90, 95 or 100% sequence identity to SEQ ID No.:95; and optionally f) a polypeptide having Pimeloyl-[acyl-carrier protein] methyl ester esterase (BioH; EC:3.1.1.85) such as a polypeptide with an amino acid sequence having 80, 85, 90, 95 or 100% sequence identity to SEQ ID No.:99; or g) a polypeptide having 6-carboxyhexanoate-CoA ligase activity (BioW; EC 6.2.1.14); such as a polypeptide with an amino acid sequence having 80, 85, 90, 95 or 100% sequence identity to SEQ ID No.:101;

The transgene encoding BioB together with one or more additional transgenes encoding polypeptides that catalyze additional steps in the biotin pathway, are located in the genome of the genetically modified bacterial cell, either integrated into the bacterial cell chromosome or on a self-replicating plasmid. The transgenes encoding BioB and one or more enzymes in the biotin pathway enzymes (BioABFCD and H or W) may be present in the genome within one or more operon.

The promoter driving expression of the transgene encoding BioB together with one or more additional transgenes is preferably a non-native promoter, which may be a heterologous constitutive-promoter or an inducible-promoter. When the promoter is a heterologous constitutive promoter, then a suitable promoter includes apFab family [SEQ ID Nos.:230-232] while a suitable inducible promoter includes: pBad (arabinose inducible [SEQ ID No.:233] and LacI [SEQ ID No.:234]. Suitable terminators include members of the apFAB terminator family including [SEQ ID No.: 235-237]. The selected promoter and terminator may be operably linked to the coding sequence for BioB; and to the coding sequences of the one or more coding sequences for the BioC, BioD, BioA, BioF, and either BioW or BioH polypeptides or may be operably linked to the one or more operon encoding the selected Bio polypeptides.

II A Method for Producing and Detecting Biotin Using a Genetically Modified Bacterium According to the Invention Biotin can be produced and exported using genetically modified bacterial cells of the invention (e.g. genetically modified *E. coli* cells) by introducing the cells into a culture medium suitable for supporting growth as well as comprising a carbon source suitable for the biosynthesis of biotin; and finally recovering the biotin produced by the culture, as illustrated in the Examples.

The genetically modified bacterial cells of the invention comprising a transgene encoding a biotin synthase (BioB) will produce enhanced levels of biotin when the supplied carbon source includes desthiobiotin (DTB). When the genetically modified bacterial cells of the invention additionally comprise transgenes encoding each of BioA, BioF, BioC, BioD, and BioH or BioW they will produce biotin when the supplied carbon source is selected from among glucose, maltose, galactose, fructose, sucrose, arabinose, xylose, raffinose, mannose, and lactose (example 1, FIG. 13).

Figure 5:
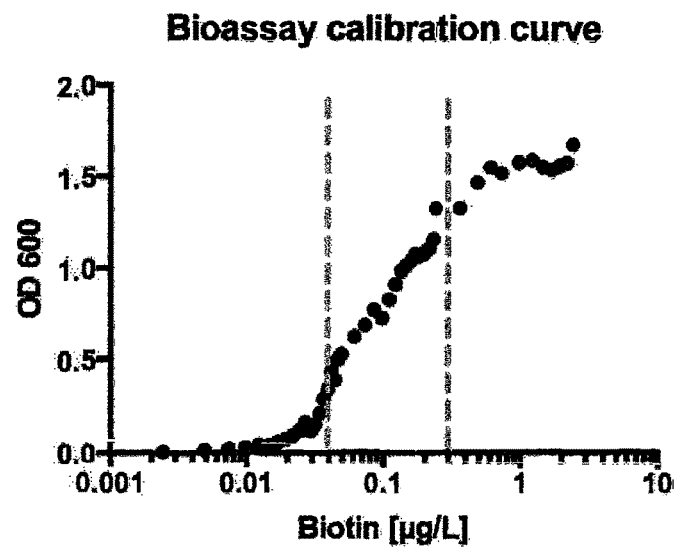
FIG. 5 Graphical presentation of a scatter plot showing the final cell density (measured at $OD_{600}$) of cultures of *E. coli* BS1011 comprising plasmid pBS451 grown on 150 μL mMOPS medium with 40 μg/ml zeocin supplemented with zero or increasing concentrations of biotin, ranging up to 0.244 μg biotin/mL after incubation for 20 hours at 37° C. with 275 rpm shake (as described under method for quantifying biotin). The stippled vertical grey lines identify an optimal concentration range of between 0.024 to 0.24 μg biotin/L for the biotin bioassay.

A method for quantifying extracellular biotin produced by a genetically modified bacterial cell of the invention is described in example 1.5. The method is a bioassay, based on measuring the growth of a biotin-starved overnight culture of BS1011 comprising plasmid pBS451 in a biotin-deficient growth medium that is supplemented with the extracellular growth medium derived from culturing cells of the invention. A biotin bioassay calibration curve is prepared by measuring the growth of the biotin-starved overnight culture, when supplemented with a known concentration range of biotin standards, as shown in FIG. 5.

III a Genetically Modified Bacterial Cell for Production of Lipoic Acid

Figure 2:
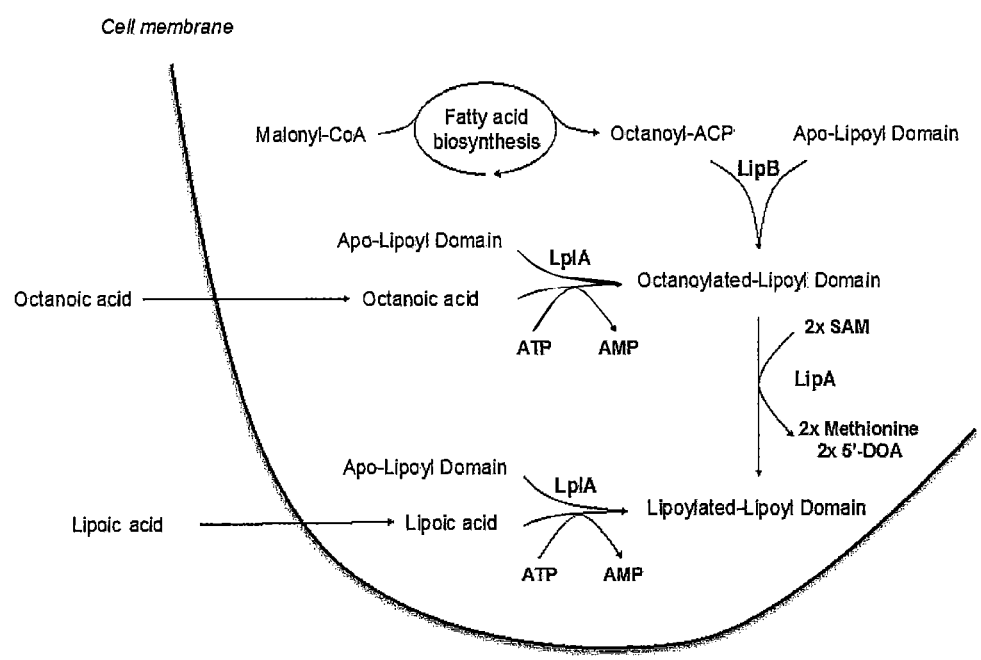
FIG. 2 Cartoon showing intermediates of the lipoic acid pathway in bacteria and the respective enzymatic steps leading to lipoylated lipoyl domains (lipoic acid synthesis). The key enzymes in the pathway include LipA (lipoic acid synthase) and LipB (octanoyl protein ACP carrier protein: protein transferase), as well as the substrate SAM: S-adenosyl-L-methionine. LplA is a lipoate-protein ligase A; EC:6.3.1.20.

The present invention provides a genetically modified bacterial cell capable of producing enhanced levels of lipoic acid. The bacterial cell is genetically modified to express a mutant IscR, according to the invention (see Section I), in substitution for a wild type IscR, as well as comprising a transgene encoding a lipoic acid synthase (EC 2.8.1.8). LipA catalyzes the conversion of covalently attached octanoyl-domains to lipoyl domains by facilitating the formation of two sulfur bonds. Optionally, the genetically modified bacterial cell may further comprise one or more additional transgenes encoding polypeptides that catalyze additional steps in the lipoic acid synthesis pathway (FIG. 2), more specifically the encoded polypeptide LipB; EC:2.3.1.181 of for example the lipB gene, and the encoded polypeptide E2; EC:2.3.1.12 of for example the aceF gene. An increase in the levels of those polypeptides that catalyze steps in the lipoic acid pathway enhances the synthesis of both intermediates in the pathway, and the end product of the pathway in the bacterial cell. An additional transgene encoding LplA, a lipoate-protein ligase A; EC:6.3.1.20, serves to facilitate synthesis of lipoic acid in cells fed with octanoic acid; by catalysing the transfer of an octanoyl moiety onto an activated lipoyl domain.

The lipoic acid synthases are encoded by genes found in a wide range of bacteria and fungi belonging to a wide range of genera. The amino add sequence of the polypeptide having lipoic synthase activity has at least 70, 75, 80, 85, 90, 95, 96, 98, 100% amino add sequence identity to a sequence selected from any one of: SEQ ID No.: 103 (origin: *Escherichia coli*); SEQ ID No.: 105 (origin: *Bacillus subtilis*); SEQ ID No.: 107 (origin: *Saccharomyces cerevisiae*); SEQ ID No.: 109 (origin: *Pseudomonas putida*); SEQ ID No.: 111 (origin: *Bacteroides fragilis*); and SEQ ID No.: 113 (origin: *Streptomyces coelicolor*).

The polypeptides that are encoded by the additional transgenes in the genetically modified bacterial cell, and whose activity serves to enhance the synthesis of both intermediates and products of the lipoic add pathway, are as follows:

a) a polypeptide having octanoyltransferase activity (for transfer of an octanoyl residue from ACP to the apo-lipoyl domain of the E2 subunit of a target enzyme activity; LipB; EC: 2.3.1,181, such as a polypeptide with an amino acid sequence having 80, 85, 90, 95 or 100% sequence identity to SEQ ID No.:115 (origin: *Escherichia coli*) or SEQ ID No.:117 (origin: *Shigella flexneri*);

b) a polypeptide comprising the dihydrolipoyllysine-residue acetyltransferase component of pyruvate dehydrogenase (E2; EC:2.3.1.12), such as a polypeptide with an amino acid sequence having 80, 85, 90, 95 or 100% sequence identity to SEQ ID No.:119 (origin: *Escherichia coli*), or SEQ ID No.:121 (origin: *Klebsiella oxytoca*) or SEQ ID No.: 239 (hybrid sequence).

c) a polypeptide having lipoate-protein ligase A (LplA; EC:6.3.1.20) activity, such as a polypeptide with an amino add sequence having 80, 85, 90, 95 or 100% sequence identity to SEQ ID No.:123 (origin: *Escherichia coli*) or SEQ ID No.:125 (origin: *Klebsiella oxytoca*).

The transgene encoding lipoic acid synthase together with one or more additional transgenes encoding polypeptides that catalyze additional steps in the lipoic acid pathway, are located in the genome of the genetically modified bacterial cell, either integrated into the bacterial cell chromosome or on a self-replicating plasmid. The transgene encoding LipA and one or more of the transgenes (lpB, lplA, and AceF) encoding enzymes in the lipoic acid pathway enzymes may be present in the genome within one or more operon.

The promoter driving expression of the transgene encoding LipA and one or more additional transgenes is preferably a non-native promoter, which may be a heterologous constitutive-promoter or an inducible-promoter. When the promoter is a heterologous constitutive promoter, then a suitable promoter includes the apFab family [SEQ ID Nos.:230-232], while a suitable inducible promoter includes: pBad (arabinose inducible [SEQ ID No.:233] and LacI [SEQ ID No.:234]. Suitable terminators include members of the apFAB terminator family including [SEQ ID No.: 235-237]. The selected promoter and terminator may be operably linked to the respective gene, either to provide individual gene regulation or for regulation of an operon.

IV A Method for Producing and Detecting Lipoic Acid Using a Genetically Modified Bacterium to the Invention Lipoic acid can be produced using genetically modified bacterial cells of the invention (e.g. genetically modified *E. coli* cells) by introducing the cells into a suitable culture medium; and finally recovering the lipoic acid produced by the cells, as illustrated in the example 2 and FIG. 14).

The genetically modified bacterial cells of the invention comprising a transgene encoding a lipoic acid synthase (LipA) will produce lipoic acid when the supplied carbon source includes Octanoic Acid (OA). The cells will produce lipoic acid when supplied with a suitable carbon source for example a source selected from among glucose, maltose, galactose, fructose, sucrose, arabinose, xylose, raffinose, mannose, and lactose.

A method for quantifying cellular lipoic acid produced by a genetically modified bacterial cell of the invention is described in example 2. The method is a bioassay, based on measuring the growth of a lipoic acid-dependent auxotrophic *E. coli* strain on a minimal medium supplemented with the lipoic add extracted from cells of the invention.

V A Genetically Modified Bacterial Cell for Production of Thiamine

The present invention provides a genetically modified bacterial cell capable of producing enhanced levels of thiamine. The bacterial cell is genetically modified to express a mutant IscR, according to the invention (see section I), in substitution for a wild type IscR, as well as comprising a transgene encoding a phosphomethylpyrimidine synthase, also called HMP-P synthase (EC 4.1.99.17), encoded by thiC; or a tyrosine lyase (also called 2-iminoacetate synthase (EC 4.1.99.19) encoded by thiH.

Figure 3:
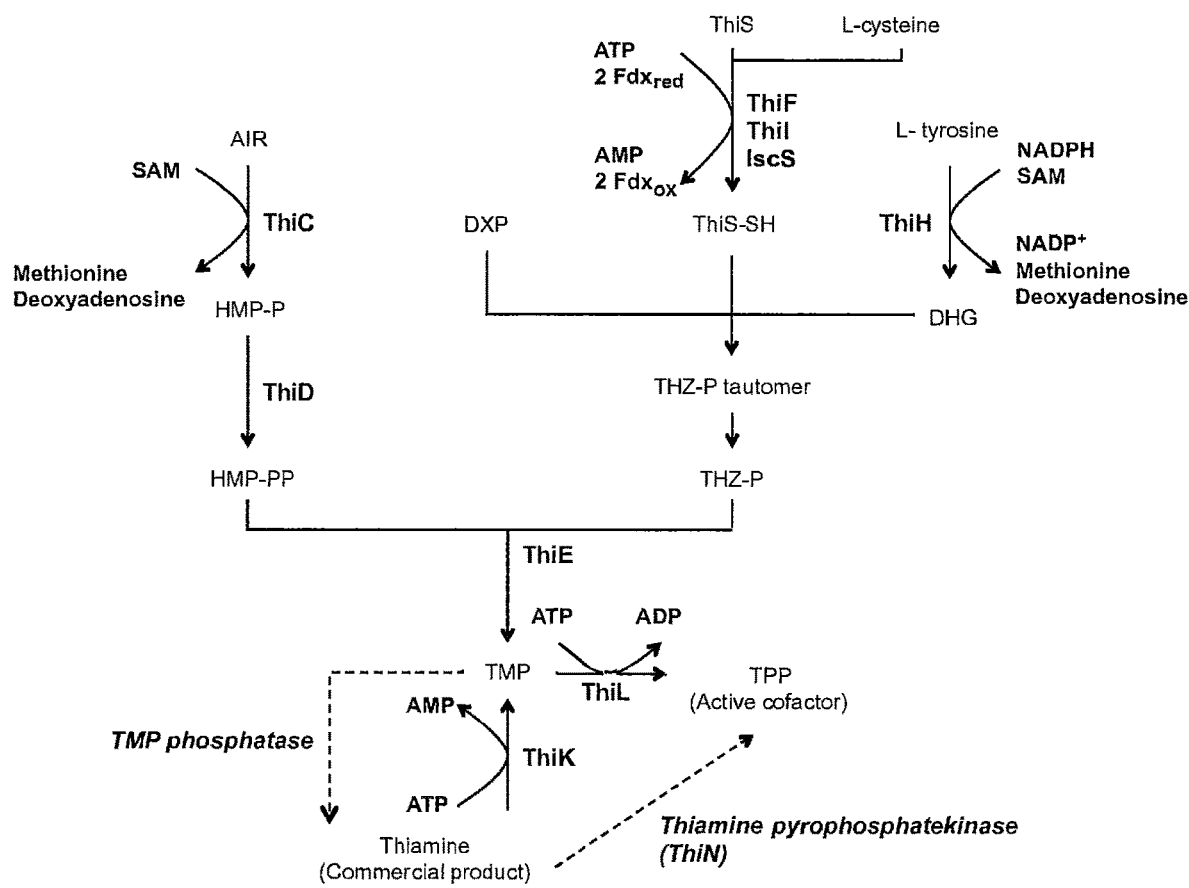
FIG. 3 Cartoon showing intermediates of the thiamine pathway in bacteria and the respective enzymatic steps leading to synthesis of thiamine (THI); thiamine monophosphate (TMP) and thiamine diphosphate (WP). Abbreviation of intermediates: 5-aminoimidazole ribonucleotide (AIR), 4-amino-2-methyl-5-(phosphooxymethyl)pyrimidine (HMP-P), 4-amino-2-methyl-5-(diphosphomethyl) pyrimidine (HMP-PP), 1-deoxy-D-xylulose 5-phosphate (DXP), dehydroglycine (DHG), 4-methyl-5-(2-phosphooxyethyl) thiazole (THZ-P), adenosine triphosphate (ATP), adenosine monophosphate (AMP), S-adenosyl-L-methionine (SAM), reduced nicotinamide adenine dinucleotide phosphate (NADPH), nicotinamide adenine dinucleotide phosphate (NADP+), reduced ferredoxin (Fdx red), oxidized ferredoxin (Fdx ox).

The genetically modified bacterial cell may further comprise one or more additional transgenes encoding polypeptides that catalyze additional steps in the thiamine synthesis pathway (FIG. 3). An increase in the levels of those polypeptides that catalyze steps in the thiamine pathway enhances the synthesis of both intermediates in the pathway, and the end product of the pathway in the bacterial cell. For example the bacterial cell may further comprise one or more transgenes encoding: ThiE thiamine phosphate synthase (EC 2.5.1.3); a [ThiS] adenylyltransferase (EC 2.7.7.73) (encoded e.g. by the thiF gene); a ThiG thiazole synthase (E.C. 2.8.1.10); ThiS sulfur-carrier protein; a ThiD phosphohydroxymethylpyrimidine kinase (EC 2.7.4.7) and a thiamine mono-phosphate phosphatase (E.C. 3.1.3.-); a ThiO glycine oxidase (EC 1.4.3.19); and a ThiM hydroxyethylthiazole kinase (2.7.1.50).

HMP-P synthases are found in a wide range of bacteria and fungi belonging to a wide range of genera. The amino add sequence of the polypeptide having HMP-P synthase activity has at least 70, 75, 80, 85, 90, 95, 96, 98, 100% amino acid sequence identity to a sequence selected from any one of: SEQ ID No.: 201 (origin: *Escherichia coli*); SEQ ID No.: 203 (origin: *Synechococcus_elongatus*); SEQ ID No.: 205 (origin: *Corynebacterium glutamicum*); SEQ ID No.: 207 (origin *Candidatus Baumannia cicadellinicola*).

Tyrosine lyases are also called 2-iminoacetate synthase (EC 4.1.99.19). The amino acid sequence of the polypeptide having HMP-P synthase activity has at least 70, 75, 80, 85, 90, 95, 96, 98, 100% amino acid sequence identity to the sequence of: SEQ ID No.:217.

The polypeptides that are encoded by the one or more additional transgenes in the genetically modified bacterial cell, and whose activity serves to enhance the synthesis of both intermediates and products of the thiamine pathway, are as follows:

a) a polypeptide having [ThiS] adenylyltransferase (EC 2.7.7.73) activity, such as a polypeptide with an amino acid sequence having 80, 85, 90, 95 or 100% sequence identity to SEQ ID No.:211;

b) a polypeptide having thiamine phosphate synthase (EC 2.5.1.3) activity, such as a polypeptide with an amino acid sequence having 80, 85, 90, 95 or 100% sequence identity to SEQ ID No.:209;

c) a polypeptide having thiazole synthase (E.C. 2.8.1.10) activity, such as a polypeptide with an amino acid sequence having 80, 85, 90, 95 or 100% sequence identity to SEQ ID No.:215;

d) a polypeptide having phosphohydroxymethylpyrimidine kinase (EC 2.7.4.7) activity, such as a polypeptide with an amino acid sequence having 80, 85, 90, 95 or 100% sequence identity to SEQ ID No.:225;

e) a polypeptide having glycine oxidase (EC 1.4.3.19) activity; such as a polypeptide with an amino acid sequence having 80, 85, 90, 95 or 100% sequence identity to a sequence selected from among SEQ ID No.:219, 221, and 223;

f) a polypeptide having ThiS sulfur-carrier activity such as a polypeptide with an amino acid sequence having 80, 85, 90, 95 or 100% sequence identity to SEQ ID No.:213;

g) a polypeptide having thiamine mono-phosphate phosphatase (E.C. 3.1.3.-) activity; such as a polypeptide with an amino acid sequence having 80, 85, 90, 95 or 100% sequence identity to a sequence selected from any one of SEQ ID No.:127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199; and h) a polypeptide having ThiM hydroxyethylthiazole kinase activity (2.7.1.50), such as a polypeptide with an amino acid sequence having 80, 85, 90, 95 or 100% sequence identity to SEQ ID No.:227.

Preferably, the genetically modified bacterial cell comprises transgenes encoding the enzymes: ThiC (encoded by a thiC gene); ThiD (encoded by a thiD gene), ThiE (encoded by a thiE gene), ThiF (encoded by a thiF gene), sulfur-carrier protein (encoded by a thiS gene), ThiG (encoded by a thiG gene), TMP phosphatase (encoded by a TMP phosphatase gene); and either ThiH (encoded by a thiH gene) or ThiO (encoded by a thiO gene). According to the embodiment, the cells may further comprise a transgene encoding the enzyme ThiM ((encoded by a thiM gene).

Thiamine synthesis levels in the genetically modified bacterium of the invention may be further enhanced by mutation of the endogenous thiL gene that encodes thiamine-phosphate kinase. The mutant thiL gene has nucleotide sequence of SEQ ID No.: 228 and compared to the parent wild-type gene has a mutation at nucleotides 133-135 (GGT to GAC) that encodes a polypeptide having a G133D substitution [SEQ ID No.: 229].

The transgene encoding HMP-P synthase (EC 4.1.99.17), encoded by thiC; or tyrosine lyase (EC 4.1.99.19) encoded by thiH, together with one or more additional transgenes encoding polypeptides that catalyze additional steps in the thiamine pathway, are located in the genome of the genetically modified bacterial cell, either integrated into the bacterial cell chromosome or on a self-replicating plasmid. The thiC or thiH transgene and one or more of the transgenes encoding enzymes in the thiamine pathway enzymes may be present in the genome within one or more operon.

The promoter driving expression of the thiC or thiH transgene and one or more additional transgenes is preferably a non-native promoter, which may be a heterologous constitutive-promoter or an inducible-promoter. When the promoter is a heterologous constitutive promoter, then a suitable promoter includes apFab family [SEQ ID Nos.:230-232] while a suitable inducible promoter includes: pBad (arabinose inducible [SEQ ID No.:233] and LacI [SEQ ID No.:234]. Suitable terminators include members of the apFAB terminator family including [SEQ ID No.: 235-237]. The selected promoter and terminator may be operably linked to the respective gene, either to provide individual gene regulation or for regulation of an operon.

VI A Method for Producing and Detecting Thiamine Using a Genetically Modified Bacterium According to the Invention Thiamine, thiamine monophosphate (TMP) and thiamine diphosphate (TPP) can be produced using genetically modified bacterial cells of the invention (e.g. genetically modified *E. coli* cells) by introducing the cells into a suitable culture medium; and finally recovering the thiamine, and additionally TPP and TMP produced by the cells, as illustrated in the Example 3 and FIG. 16.

The genetically modified bacterial cells of the invention comprising a transgene encoding a HMP-P synthase will produce thiamine, TPP and TMP when the supplied carbon source is selected from among glucose, maltose, galactose, fructose, sucrose, arabinose, xylose, raffinose, mannose, and lactose.

A method for quantifying thiamine produced by a genetically modified bacterial cell of the invention is described in example 3; and may include the use of High Pressure Liquid Chromatography, relative to a thiamine standard.

VII Methods for Engineering a Genetically Modified Bacterial Cell for Production of Biotin, Lipoic Acid or Thiamine Integration and self-replicating vectors suitable for cloning and introducing one or more transgene encoding one or more a polypeptide having an enzymatic activity associated with the synthesis of biotin, lipoic acid or thiamine in a bacterial cell of the invention are commercially available and known to those skilled in the art (see, e.g., Sambrook et al., Molecular Cloning: A Laboratory Manual, Second Edition, Cold Spring Harbor Laboratory Press, 1989). Bacterial cells are genetically engineered by the introduction into the cells of heterologous DNA. Heterologous expression of genes encoding one or more polypeptide having an enzymatic activity associated with biotin, lipoic acid or thiamine synthesis in a bacterial cell of the invention is demonstrated in Example 1, 2 and 3 respectively.

A nucleic acid molecule, that encodes one or more polypeptide having an enzymatic activity associated with biotin, lipoic acid or thiamine synthesis according to the invention, can be introduced into a host cell by means of a self-replicating vector or optionally integrated into the host cell genome using methods and techniques that are standard in the art. For example, nucleic acid molecules can be introduced by standard protocols such as transformation including chemical transformation and electroporation, transduction, particle bombardment, etc. Expressing the nucleic acid molecule encoding the enzymes of the claimed invention also may be accomplished by integrating the nucleic acid molecule into the genome.

Genetic modification of the native endogenous iscR gene in a bacterial cell of the invention can be performed by deletion (knockout) of the endogenous iscR gene and insertion/substitution with a transgene encoding a mutant IscR polypeptide as defined in section I, by applying standard recombineering methods to suitable parent bacterial cell (Datsenko K A, et al.; 2000).

The genetically modified bacterial cell according to the invention, for the production of biotin, lipoic acid or thiamine may be a bacterium, a non-exhaustive list of suitable bacteria is given as follows: a species belonging to the genus selected from the group consisting of: *Escherichia, Brevibacterium, Burkholderia, Campylobacter, Corynebacterium, Pseudomonas, Serratia, Lactobacillus, Lactococcus, Acetobacter, Acinetobacter, Pseudomonas*, etc.

Preferred bacterial species of the invention are *Escherichia coli, Pseudomonas putida, Serratia marcescens* and *Corynebacterium glutamicum*.

VIII Biotin Production Capacity of Genetically Modified Bacterial Cells of the Invention is Enhanced by Increased Electron Transfer.

SAM-radical iron-sulfur cluster enzymes containing an oxidized [4Fe-4S]$^{2+}$ cluster, e.g. BioB, ThiC and LipA, need electron transfer for reduction to a [4Fe-4S]$^+$ cluster. Only the reduced [4Fe-4S]$^+$ cluster is able generate the SAM-radical needed for catalysis. The electron transfer from the electron donor NADPH to the [4Fe-4S]$^{2+}$ cluster can be mediated by a flavodoxin/ferredoxin reductase (Fpr) and flavodoxin (FldA) reduction system or by a Pyruvate-flavodoxin/ferredoxin oxidoreductase system.

In a further embodiment, the genetically modified bacterial cell according to the present invention, that is capable of producing either biotin, lipoic acid or thiamine, further comprises one or more genes selected from the group: a gene encoding a flavodoxin/ferredoxin-NADP reductase (EC: 1.18.1.2 and EC 1.19.1.1); a gene encoding a pyruvate-flavodoxin/ferredoxin oxidoreductase (EC 1.2.7); a gene encoding a flavodoxin; a gene encoding a ferredoxin; a gene encoding a flavodoxin and a ferredoxin-NADP reductase. Promoter(s), operably-linked to each of said one or more genes are capable of enhancing expression of said one or more genes in said bacterium; wherein each said one or more genes may be a native gene or a transgene. Preferably, the operably-linked promoter, enhances expression of said one or more genes in said bacterium to a level greater than in the parent bacterium from which the genetically-modified bacterium of the invention was derived. Preferably, the genetically modified bacterial cell according to the present invention comprises a gene encoding a flavodoxin/ferredoxin-NADP reductase (EC:1.18.1.2 and EC 1.19.1.1) and a gene encoding a flavodoxin; or a single gene comprising coding sequences for both a flavodoxin and a ferredoxin-NADP reductase. Additionally said genetically modified bacterial cell may further comprise a gene encoding a ferredoxin.

Overexpression of genes expressing components of the electron transfer pathway in genetically modified bacterial cells of the present invention, enhances the cellular activity of their SAM-radical iron-sulfur cluster enzymes (as illustrated in Example 4 for biotin-producing cells of the invention).

Preferably, when the polypeptide encoded by a native gene or transgene in the genetically modified bacterial cell of the invention has flavodoxin/ferredoxin reductase activity (EC:1.18.1.2 and EC 1.19.1.1), it has an amino acid sequence having 80, 85, 90, 95 or 100% sequence identity to a sequence selected from any one of: SEQ ID No.: 241 (origin: fpr gene from *E. coli*); SEQ ID No.:243 (origin: yumC gene from *Bacillus subtilis* 168); SEQ ID No.:245 (origin: fpr-I gene from *Pseudomonas putida* KT2440); SEQ ID No.:247 (origin: SVEN_0113 gene from *Streptomyces venezuelae* ATCC 10712-); SEQ ID No.:249 (origin: Cgl2384 gene from *Corynebacterium glutamicum* ATTCC 13032), and SEQ ID No.:251 (origin: SJN15614.1 gene from *Sphingobacherium* sp. JB170.

Preferably, when the polypeptide encoded by a native gene or transgene in the genetically modified bacterial cell of the invention has pyruvate-flavodoxin/ferredoxin oxidoreductase activity (EC 1.2.7), it has an amino acid sequence having 80, 85, 90, 95 or 100% sequence identity to a sequence selected from any one of: SEQ ID No.: 253 (origin: YdbK gene from *E. coli* K12 MG1655); SEQ ID No.: 255 (origin: por gene from *Geobacter sulfurreducens* AM-1); SEQ ID No.: 257 (origin: Sfla_2592 gene from *Streptomyces pratensis* ATCC 33331; SEQ ID No.: 259 (origin: RM25_0186 gene from *Proplonibacterium freudenrelchii* DSM 20271); SEQ ID No.: 261 (origin: nifJ gene from *Synechocystis* sp. PCC 6803)

Preferably, when the polypeptide encoded by a native gene or transgene in the genetically modified bacterial cell of the invention is a flavodoxin, it has an amino acid sequence having 80, 85, 90, 95 or 100% sequence identity to a sequence selected from any one of: SEQ ID No.: 263 (origin: fldA gene from *Escherichia coli* K12 MG1655); SEQ ID No.: 265 (origin: fldB gene from *Escherichia coli* K12 MG1655); SEQ ID No.: 267 (origin: ykuN gene from *Bacillus subtilis* 168); SEQ ID No.: 269 (origin: isiB gene from *Synechocystis* sp. PCC 6803; SEQ ID No.: 271 (origin: wrbA gene from *Streptomyces venezuelae* ATCC 10712); SEQ ID No.: 273 (origin: PRK06242 gene from *Methanococcus aeolicus* Nankai-3).

Preferably, when the polypeptide encoded by a native gene or transgene in the genetically modified bacterial cell of the invention is a ferredoxin, it has an amino acid sequence having 80, 85, 90, 95 or 100% sequence identity to a sequence selected from any one of: SEQ ID No.: 275 (origin: fdx gene from *E. coli*); SEQ ID No.: 277 (origin: fer gene from *Bacillus subtilis* 168); SEQ ID No.: 279 (origin: fdxB gene from *Corynebacterium glutamicum* ATTCC 13032); SEQ ID No.: 281 (origin: fdx gene from *Synechocystis* sp. PCC 6803); SEQ ID No.: 283 (origin: SVEN_7039 gene from *Streptomyces venezuelae* ATCC 10712); SEQ ID No.: 285 (origin: fdx gene from *Methanococcus aeolicus* Nankai-3).

A promoter(s) that is capable of enhancing gene expression when operably-linked of a native gene or to a transgene encoding polypeptides of the electron transport pathway in said bacterium is preferably a non-native promoter. Said promoter may be a member of the constitutive apFAB309 promoter family [SEQ ID Nos.:230-232]. Preferably said non-native promoter, when operably-linked to said native gene or transgene enhances expression of said encoded polypeptide(s) in said genetically modified bacterium to a level greater than the parent bacterium from which it was derived. Suitable terminators that may be operably-linked to said native gene or transgene includes the apFAB378 terminator family [SEQ ID No.: 235-237].

EXAMPLES

Example 1: Identification and Characterization of Genetically Modified *E. coli* Strains Capable of Enhanced Biotin Production 1 Methods 1.1: The Following Strains of *Escherichia coli* Used in the Examples are Listed Below.

TABLE 1

Strains

| Name | Description |
|---|---|
| BS1013 | *E. coli* K-12 BW25113 parent strain having genotype: rrnB3 ΔlacZ4787 hsdR514 Δ(araBAD)567 Δ(rhaBAD)568 rph-1 |
| BS1011 | ΔbioB [1](JW0758-1) derived from *E. coli* K-12 BW25113 |
| BS1353 | BS1011 derivative comprising a H107Y mutation in iscR |
| BS1113 | BS1011 derivative comprising pBS412 plasmid giving IPTG - inducible BioB expression |

TABLE 1-continued

Strains

| Name | Description |
|---|---|
| BS1375 | BS1011 derivative comprising a C92Y mutation in iscR |
| BS1377 | BS1011 derivative comprising a L15F mutation in iscR |

[1]Nucleotide sequence of ΔbioB gene prior to deletion was SEQ ID No. 21

1.2: The Following Plasmids Used in the Examples are Listed Below.

TABLE 2

Plasmids

| Name | Description |
|---|---|
| pBS412 | BioB [SEQ ID No: 22] overexpression plasmid (kanR, SC101) from a T5 lacO repressed promoter |
| pBS430 | pBS412 with frame shift mutation early in bioB [1](kanR, SC101) from a T5 lacO repressed promoter [SEQ ID No.: 25] |
| pBS451 | Constitutively expressed GFP [SEQ ID No.: 287] (zeoR, p15A) |
| pBS281 | E. coli isc operon (iscSUA-hscBA-fdx) from an IPTG inducible T5 promoter cloned in a medium copy number plasmid (p15A ori) |
| pBS282 | E. coli suf operon (sufABCDSE) from an IPTG inducible T5 promoter cloned in a medium copy number plasmid (p15A ori) |
| pBS231 | A medium copy number plasmid (p15A ori) expressing a gene encoding a sfGFP protein from an IPTG inducible T5 promoter |
| pBS936 | Native biotin-operon from E. coli with "type 9" mutation in bio operator site (Ifuku et al., 1993) |

[1]Nucleotide sequence of bioB frameshift gene has SEQ ID No. 23

1.3 Media and Additives:

The growth media (mMOPS) used in each example had the following composition: 1.32 mM K2HPO4; 2 g/l D-glucose; 0.0476 mg/l calcium pantothenate; 0.0138 mg/l p-aminobenzoic acid; 0.0138 mg/l p-hydroxybenzoic acid; 0.0154 mg/l 2,3-dihydroxybenzoic acid, and 1× modified MOPS buffer.

10× modified MOPS comprises 0.4 M MOPS (3-(N-morpholino)propane sulfonic acid); 0.04 M Tricine; 0.1 mM $FeSO_4 \cdot 7H_2O$; 95 mM $NH_4Cl$; 2.76 mM $K_2SO_4$; 5 μM $CaCl_2 \cdot 2H_2O$; 5.25 mM $MgCl_2$; 0.5 M NaCl; and 5000× dilution of micronutrient stock solution.

Micronutrient Stock Solution:

| Component | Formula | FW | Grams per 50 ml |
|---|---|---|---|
| ammonium molybdate | $(NH_4)_6Mo_7O_{24} \cdot 4H_2O$ | 1235.9 | 0.009 |
| boric acid | $H_3BO_3$ | 61.83 | 0.062 |
| cobalt chloride | $CoCl_2$ | 237.9 | 0.018 |
| cupric sulfate | $CuSO_4$ | 249.7 | 0.006 |
| manganese chloride | $MnCl_2$ | 197.9 | 0.040 |
| zinc sulfate | $ZnSO_4$ | 287.5 | 0.007 |

The following antibiotic stocks were employed: ampicillin (amp, 100 mg/mL), kanamycin (kan, 50 mg/mL), zeocin (zeo, 40 mg/mL); that were added to growth media as indicated to obtain a 1000× dilution.

1.4 Establishing of E. coli Strain Libraries:

E. coli libraries having evolved genomic diversity were derived from cells of E. coli strain BS1011 comprising plasmid pBS412 by subjecting the cells to stationary overnight culture in mMOPS medium supplemented with kan (MOPS-kan), preparing a 100× dilution of resulting culture in mMOPS-kan and repeating the consecutive steps of overnight culture and dilution 5 times. This procedure creates genetic diversity by allowing the accumulation of background mutation generated by imperfect error-correcting polymerases. After each round of culture and dilution a sample of the cell culture was plated on mMOPS plates with IPTG (see below), to detect the evolution of cells adapted to tolerate enhanced BioB expression. Cells of each library were then transformed with the BioB over-expression plasmid, pBS412.

1.5 Selection of Mutant Strains

A selection assay was developed by plating respectively $10^4$, $10^5$, $10^6$ and $10^7$ cells, derived from an o/n culture in mMOPS-kan of BS1011 comprising pBS412, on a series of 1.5% agar plates comprising mMOPS (Ø=9 cm) comprising IPTG concentrations of either 0, 0.0001, 0.001, 0.01, 0.1 and 1 mM. The plates were then incubated at 37° C. for up to 36 hours and cell growth was evaluated at intervals. Under these conditions, induction of BioB expression from pBS412 with 0.1 mM IPTG was found to prevent growth of up to 10^5 cells, while induction with 1 mM IPTG prevented growth of at least 10^7 cells when plated on a single petri dish. A selection pressure comprising induction with 1 mM IPTG for a cell population of 10^5 cells was found optimal for identifying strains with higher robustness towards BioB expression; and accordingly was implemented as follows:

1) Approximately $10^5$ cells from each library, as described in section 1.4, were plated on each mMOPS-kan −1 mM IPTG agar plate, and incubated at 37° C. for maximum 24 hours.

2) Single colonies were grown in mMOPS-kan liquid medium to produce pre-cultures, that were then evaluated for their biotin production by means of a biotin bioassay (as described in section 1.6 below) that was performed in mMOPS-kan supplemented with either 0.00, 0.01 or 0.1 mM IPTG. Cells of each pre-culture were preserved as glycerol stocks in 20% glycerol.

3) Colonies producing more than 1.5 mg biotin/l (detected as extracellular biotin) were re-streaked on mMOPS-kan agar plates, incubated at 37° C. for up to 24 hours, and then re-bioassayed for biotin production in biological replicates (as detailed in section 1.6 below).

4) Cells of the selected biotin over-producing strains were evaluated as follows:
   a) Whole genome sequencing to identify genetic mutations in the genome of cells of selected strains as compared to the genome of the parent strain BS1011 was performed on DNA isolated from cells of the selected strain as follows: Selected cells were grown in 5-10 mL mMOPS-kan and the cells were subsequently harvested; genomic DNA was isolated from the harvested cells using Invitrogen Purelink genomic DNA extraction kit:
   (https://www.thermofisher.com/order/catalog/product/K182001); the extracted DNA was subjected to whole genome sequencing.
   b) Curing cells of the selected strains of their pBS412 plasmid; then re-transforming the cells of the cured strain with the pBS412 plasmid; and finally redoing bioassay of cultures of cells of the transformed strains for biotin production. The steps of curing cells of their pBS412 plasmid were performed by growing the cells in rich, Luria Broth (LB) media with 1 mM IPTG without antibiotics overnight at 37° C.; streaking out cells of the resulting culture on LB agar plates and incubating overnight at 37° C. Single colonies from the agar plates were diluted in 50 µl LB media and 5 µl were used to spot on LB and LB-amp agar plates, which were incubated overnight at 37° C. Those single colonies that grew on LB plates, but not on LB-amp plates, were re-streaked on LB plates to obtain single colonies, which were used as cured strain for re-transformation.

Biotin production by cells of the transformed strains where measured in biological replicates (as detailed in section 1.6 below). Briefly, biotin production re-evaluated for biological replicates in mMOPS-kan supplemented with 0.00, 0.01 or 0.1 mM IPTG. In parallel, the growth rates of the cells of each transformed strain were measured in 200 µL mMOPS-kan medium in a microtiter plate sealed with transparent breathable seal at 37° C. with "fast shaking" for aerobic growth, for a period of 24 hours in a Multiskan FC. Cell growth was monitored by measuring OD620 every 30 minutes.

1.6 Bioassay for Quantifying Biotin Production

Pre-cultures were each prepared from a selected single cell colony in 400 µL mMOPS-kan in a 96 deep-well plate, incubated at 37° C. with shake at 275 rpm for 16-18 hours. Production cultures were produced by inoculating 400 µL mMOPS-kan, supplemented with 0.1 g/L desthiobiotin (DTB), and optionally comprising IPTG at a final concentration of up to 1 mM, in a 96 deep-well plate, with 4 µL of the pre-culture sufficient to provide an initial OD600 of ~0.03. Cultures were then grown at 37° C. with 275 rpm shake for 24 hours. Cells in the 96 deep-well plate were pelleted by centrifuging at 4000 G for 8 minutes after measuring $OD_{600}$ of the cultures. The supernatant from each culture supernatant was diluted to a concentration range of 0.05 nM to 0.50 nM biotin in ultrapure (Milli-Q) water. In parallel, >5 biotin standards in the concentration range of 0.1 nM (0.024 µg biotin/L) to 1 nM (0.24 µg biotin/L), were prepared in Milli-Q water. 15 µL of each diluted supernatant and each of the biotin standards was then added to a well of a microtiter plate; wherein each well comprised 135 µL of a biotin-starved overnight culture of BS1011 comprising plasmid pBS451; and where the overnight culture was diluted to an initial $OD_{620}$ of 0.01 in mMOPS supplemented with zeocin. The plate was sealed with a breathable seal and incubated at 37° C. with 275 rpm shaking for 20 hours before $OD_{600}$ was measured. A biotin bioassay calibration curve obtained with this bioassay, using a range of biotin standards, is shown in FIG. 5.

1.7 Identification of Genomic Mutations

For all Next-Generation Sequencing (NGS) data, CLC genomic workbench version 9.5.3 (supplied by Qiagen) was used to identify mutations in the genome of cells of selected strains as compared to the parent strain genome (single or a few substitutions, deletions or insertions by Variant Detection and bigger insertions/deletions by InDels and Structural Variants). A cut-off of 85% were used to define "significant mutations" meaning that a mutation should be present in more than 85% of the population of DNA molecules (genomes) Isolated from cells of a given bacterial strain, in order to distinguish genome mutations from erroneous nucleotides introduced by the sequencing procedure.

The genome accession number CP009273 from NCBI was used as the reference sequence, while taking account of the Keio ΔbioB scar mutation whose sequence was confirmed by sequencing.

1.8 Characterizing Proteomics Landscape of iscR Mutant

Protein content of BS1013+pBS430, BS1011+pBS412 and BS1353+pBS412 at 0.025 mM IPTG induction levels as well as BS1353+pBS412 at 1 mM IPTG induction were determined by a recently developed approach combining LC-MS and efficient protein extraction (Schmidt et al, 2015). 3 peptides were chosen as minimum number of identified peptides for analysis along with a peptide threshold of 2.0% FDR. Significant changes in protein expression are reported with a 0.5% confidence interval based on Analysis of Variance (ANOVA) with Benjamini-Hochberg correction for multiple testing using a Scaffold Viewer 4.7.5.

Strains were grown in mMOPS with IPTG induction for approximately 10 generations, until $OD_{600}$ of 0.5 were reached (exponential phase). $10^8$ cells were harvested by centrifugation at 4° C. at maximum speed; washed once in ice-cold PBS buffer; re-pelleted by centrifugation at 4° C. at maximum speed and snap-frozen in liquid nitrogen, after removing PBS buffer.

2. Results 2.1 Overexpression of BioB is Toxic

Figure 4:
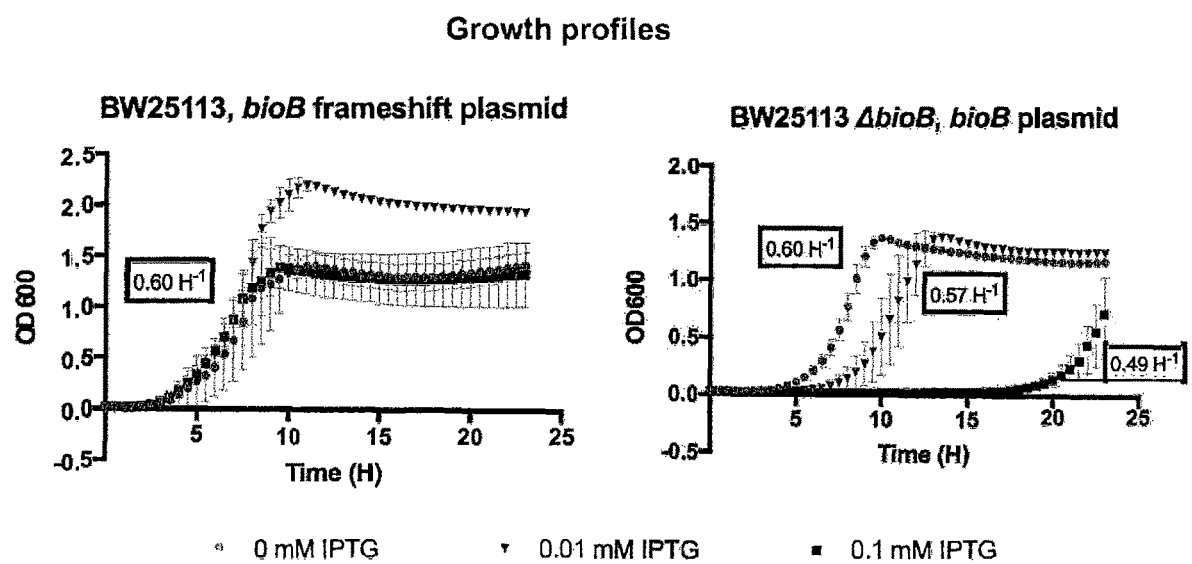
FIG. 4 Graphical presentation of the cell density (measured at $OD_{600}$), measured over time, of a (*E. coli* BW25113) ΔbioB strain comprising an IPTG inducible bioB expression plasmid (right panel); and the reference (*E. coli* BW25113) strain comprising an IPTG inducible frame-shifted bioB (premature stop codon) expression plasmid (left panel). $OD_{620}$ was measured using a Multiskan and converted to $OD_{600}$, for 4 biological strain replicates grown in 200 μL mMOPS with 0.1 g/L DTB, 50 μg/mL kanamycin and 0 (dots) 0.01 (triangles) or 0.1 (squares) mM IPTG. Respective exponential growth rate values are shown in the adjacent boxes.

*E. coli* retaining its native biotin synthase gene (bioB) but expressing an IPTG-Inducible frameshifted *E. coli* bioB gene (encoding non-functional biotin synthase due to a premature stop codon) from a low-copy plasmid (Sc101 origin of replication) is able to grow aerobically in mMOPS-kan medium with or without IPTG. This is illustrated in FIG. 4 (left panel), showing the exponential growth curve of the *E. coli* BW25113, BioB frameshift mutant. In contrast, over-expression of a functional biotin synthase gene (bioB) in the *E. coli* knock-out strain ΔbioB, is toxic for growth, causing a very significant extension in the lag phase. This is illustrated in FIG. 4 (right panel), that shows the growth of *E. coli* knock-out strain ΔbioB expressing an *E. coli* bioB gene from an IPTG-inducible T5 promoter on a low-copy plasmid (Sc101 origin of replication). As seen in FIG. 4, induction of increasing bioB expression in response to increasing IPTG levels (darkness of grey) significantly affects the lag-phase while the growth rate is affected slightly (black boxes).

2.2 Isolation of iscR Mutant Strains Having Enhanced Biotin Production Titers

Figure 6:
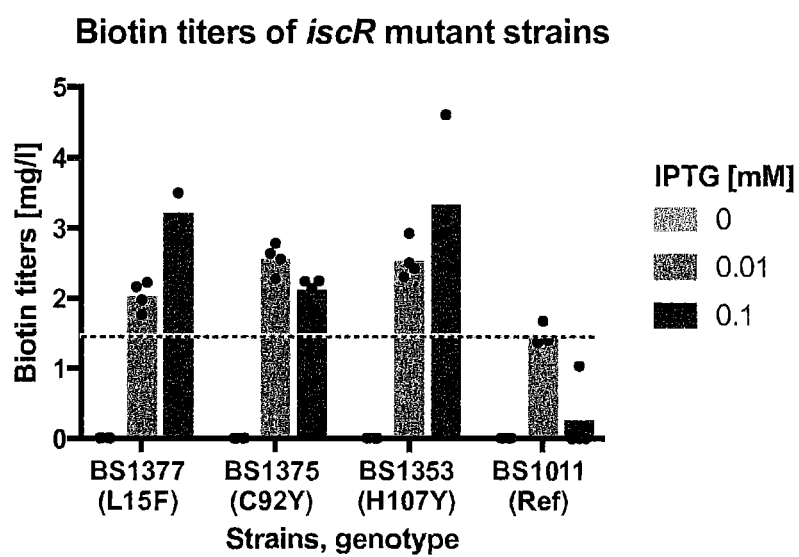
FIG. 6 Bar diagram showing biotin production of 3 different iscR mutant strains expressing mutant IscR having amino acid mutations (BS1377, L15F), (BS1375, C92Y) and (BS1353, H107Y) and an *E. coli* BW25113 ΔbioB strain (BS1011, Ref) (see Table 1 for strains) In 4 biological replicates each comprising an IPTG-inducible bioB expression plasmid (pBS412). Strains were grown in 400 μL mMOPS with 0.1 g/l DTB and 50 μg/mL kanamycin for 24 H at 37° C. with 275 rpm shake. Bars illustrate the mean biotin production value (height) and IPTG induction level (gray shade), black dots show biotin production from individual replicate cultures and the horizontal stippled line indicates the maximum biotin production from a reference wild type strain. Note that none of the strains produced detectable levels of biotin when cultured in the absence of IPTG.

*E. coli* libraries having evolved genomic diversity (see sections 1.4 and 1.5) were screened for strains with improved tolerance for bioB gene expression and increased biotin production. Whole genome sequencing of the selected strains led to the identification of three unique mutants each comprising an Iron-sulfur cluster regulator (iscR) gene encoding an IscR polypeptide having one of the amino acid substitutions: L15F, C92Y and H107Y, and where the amino acid sequence of the encoded regulators is SEQ ID No.: 16, 18 and 20 respectively. Biotin production levels were measured using a bioassay, as described in section 1.6 (and FIG. 5). The biotin production titers for each of the iscR mutant strains as well as the *E. coli* BW25113 ΔbioB reference strain are shown in FIG. 6 for 4 biological replicates (black dots) grown in mMOPS supplemented with 0.1 g/l DTB in the absence or presence of two different IPTG concentration levels (increasing IPTG with darker grey). Biotin production in the reference strain was inhibited at IPTG levels of above 0.01 mM, which corresponds to IPTG levels that are toxic for growth of the reference strain (see FIG. 4), while the IscR mutant strains both grew and produced biotin at IPTG levels of 0.01-0.1 mM IPTG. All three IscR mutant strains produce approximately 1.5 fold more biotin than the reference strain (stippled line) at an IPTG concentration of 0.01 mM. The IscR mutant strains produce up to 2-fold more (~3.2 mg biotin/l) at an IPTG concentration of 0.1 mM, than the highest production titer from the reference strain (~1.5 mg biotin/l).

2.3 Biotin Production and Growth in an IscR H107Y Mutant Strain

Figure 7:
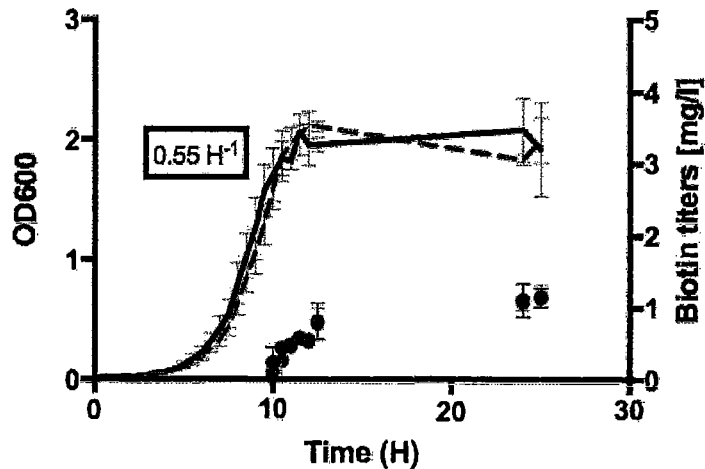
FIG. 7 Graphical presentation of the cell density and biotin production of the iscR mutant strain expressing the mutant IscR (BS1353, H107Y), and an *E. coli* BW25113 ΔbioB strain (BS1011, Ref), wherein each stain comprises an IPTG-inducible bioB gene expression plasmid (pBS412). The data represents the average measured $OD_{600}$ of three biological replicates each of the IscR H107Y mutant strain (solid dark line) and the reference strain, *E. coli* BW25113 ΔbioB strain (stippled light grey) and biotin production by the respective iscR H107Y mutant strain (solid dark dots) and the reference strain, *E. coli* BW25113 ΔbioB strain (light gray dots) monitored over a period of 25 H. The strains were grown in 50 mL mMOPS with 0.1 g/l DTB, 0.01 (A) or 0.5 mM IPTG (B) and 50 μg/mL kanamycin in a 250 mL baffled shake flask at 37° C. with 275 rpm shaking. Growth rates are shown in the black box.
Figure 7:
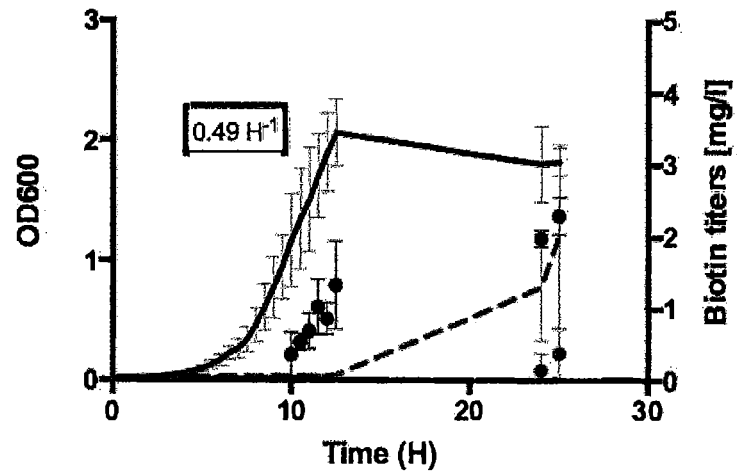

The growth profile and biotin production titer of the IscR (H107Y) mutant strain was characterized in 50 mL mMOPS supplemented with 0.1 g/l DTB in a 250 mL shake-flask experiment at two different IPTG induction levels (0.01 mM in FIG. 7A) and 0.5 mM (FIG. 7B). At low IPTG levels (FIG. 7A), the IscR mutant strain (dark grey) and the reference strain (light grey) were similar with respect to growth and biotin production titers, with a final titer of ~1.1 mg biotin/l. However, at high IPTG induction levels (0.5 mM In FIG. 7B) growth of the reference strain (light grey) was severely inhibited, while the IscR mutant strain retained the same growth profile as at low IPTG induction levels. Furthermore, the biotin production titers of the IscR mutant strain increased around 2-fold, up to ~2.2 mg biotin/l after 25 hours of growth.

2.4 Mechanism of Action of IscR Mutations

Figure 9:
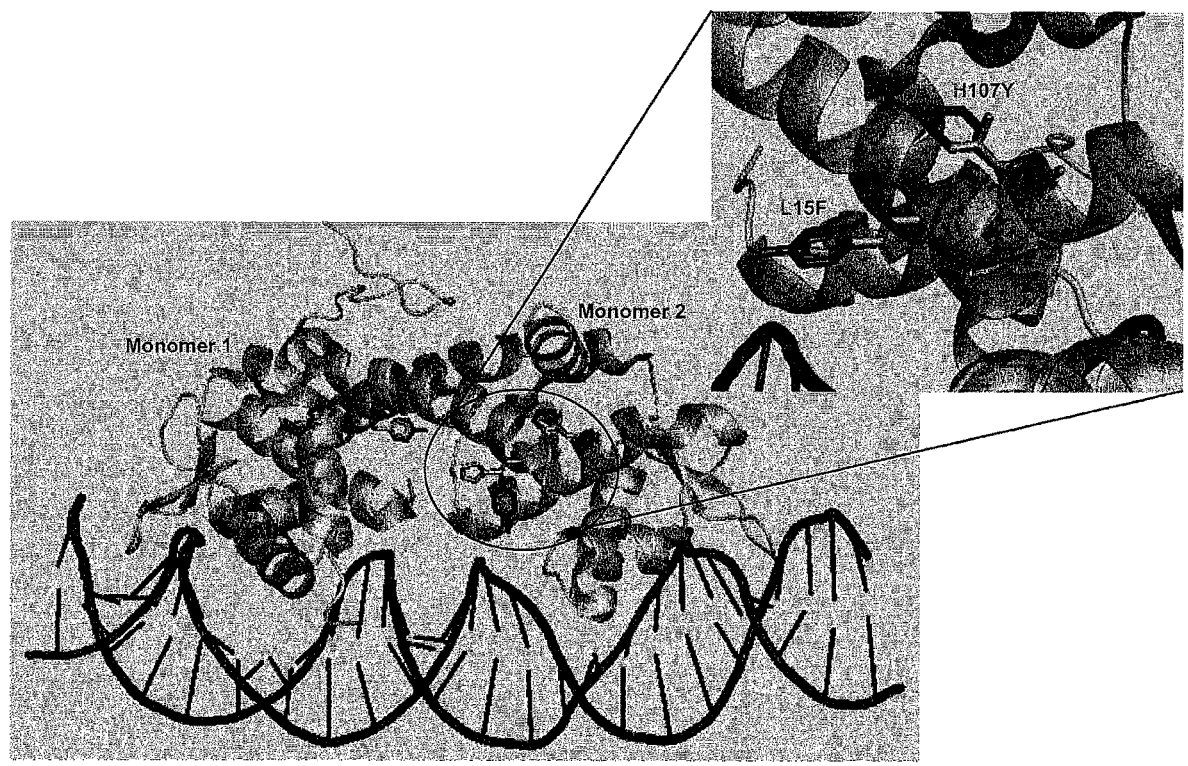
FIG. 9 Cartoon showing the crystal structure (PDB entry 4HF1) of IscR dimer (grey) bound to hya DNA binding site (black) with L15F and H107Y IscR mutants indicated as sticks (WT amino acid in grey and mutant amino acid in black); and an expanded image highlighting the mutated residues.

An enhanced biotin tolerance phenotype was clearly demonstrated for all three of the identified IscR mutant strains, as seen in FIG. 6. The ability of the C92 mutation (C92Y) to enhance biotin tolerance is suggested to be due to a role for C92 in the [Fe—S] cluster binding properties of IscR. Loss of [Fe—S] cluster binding properties due to the C92Y mutation is proposed to inactivate the isc-operon repression behavior of IscR. At the same time, it is proposed that the promoter function of IscR remains intact in the C92Y mutant IscR, such that it retains its function in activating other pathways essential for multiple cellular processes. A similar essential role in providing the [Fe—S] cluster binding properties of IscR is attributed to H107; where the H107Y mutation is similarly able to enhance biotin tolerance in *E. coli*. The L15F in IscR is also proposed to disrupt iron-sulfur cluster binding and thereby partially overcome iron-sulfur cluster depletion. FIG. 9 shows the position of the L15 and H107 in IscR when bound to DNA (binding site of hya, PDB entry 4HF1), and it can be seen that L15 is positioned at the inside of each of the IscR subunits. Phenylalanine is a significantly larger amino acid than leucine, and may interfere with the three-dimensional folding of the protein.

2.5 Overexpression of the Isc-Operon or Suf Operon in *E. coli* Strains Alone is not Sufficient to Enhance Biotin Production In order to determine the direct effect of overexpressing the isc-operon (iscSUA-hscBA-fdx, corresponding to the native *E. coli* operon structure minus the iscR gene) or the suf-operon (sufABCDSE corresponding to the native *E. coli* operon structure) on biotin production in *E. coli*, each operon was cloned into a medium copy number plasmid (p15A ori) placed under the control of a strong RBS and an IPTG inducible T5 promoter. A plasmid, comprising a gene encoding a super folder Green Fluorescent Protein (sfGFP) in substitution for the isc- or suf-operon, was employed as a control. The respective plasmids were transformed into cells of an *E. coli* strain comprising an IPTG-Inducible bioB expression plasmid. Biological triplicate colonies comprising one of: 1) IPTG-Inducible isc-operon, 2) IPTG-inducible suf-operon or 3) IPTG-inducible GFP (control) in addition to the IPTG-inducible bioB expression plasmid were assayed for biotin production (as described in section 1.5) following cultivation in 400 µL mMOPS with 100 µg/mL ampicillin and 50 µg/mL spectinomycin under low (0.01 mM IPTG) and high (0.1 mM IPTG) induction.

From the graph (FIG. 10) it can be seen that although biotin production was IPTG-inducible in all strains; the IPTG concentration needed to reach detectable biotin production levels was increased from 0.01 mM IPTG to 0.1 mM IPTG, when compared to the reference and mutant iscR strains shown in FIG. 6. Furthermore, biotin production titers were significantly decreased by the overexpression of isc- or suf-operons, when compared to both the sfGFP strain in FIG. 10. Additionally, overexpression of isc-operon depressed biotin production even more than overexpression of suf-operon. Taken together with the observed increase in biotin production seen in mutant strains having a single point mutation in iscR (FIG. 6), it is unlikely that the resulting de-repression of isc-operon in these strains is the only/main reason for improved biotin production in those strains.

2.6 BioB Protein Contents Correlates with Biotin Production

To investigate the molecular effects of BioB overexpression in wild type and mutant background strains, proteomics measurements were carried out for a wild type background strain: BS1013 holding pBS430; a wild type iscR strain with a bioB production plasmid: BS1011 holding pBS412; and a mutant iscR strain with a bioB production plasmid: BS1353 holding pBS412. All strains were grown in mMOPS with 0.1 g/L DTB and 0.025 mM IPTG. The latter strain was additionally grown at 1 mM IPTG induction. Cells were harvested for proteomics analysis in exponential phase, while the remaining cell culture were kept incubating for 24 hours in total, before biotin production were measured using the bioassay described elsewhere.

Figure 11:
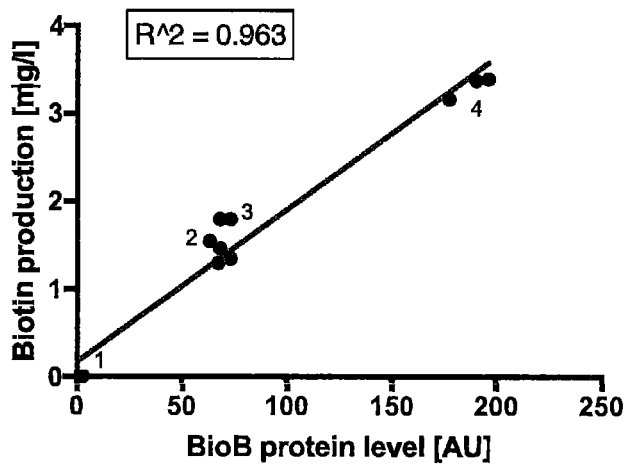
FIG. 11 Graphical presentation of the correlation between BioB protein expression levels and biotin production in 4 different samples performed in triplicate. The strains are BS1013 (*E. coli* BW25113, background strain) with pBS430 (bioB frameshift IPTG inducible plasmid), BS1011 (BS1013 with ΔbioB) with pBS412 (bioB IPTG inducible plasmid), BS1353 (BS1011 with iscR H107Y mutation) with pBS412. Strains were grown in mMOPS with 0.1 g/l DTB and IPTG as indicated in the graph.

From the graph (FIG. 11) the measured BioB protein level strongly correlates with the biotin production ($R^2$ value of 0.96). The linear correlation shows that facilitating enhanced BioB expression is a key to improve biotin production in IscR mutant cell factories. The ANOVA analysis of the proteomics data revealed a significant increase in expression (95% confidence interval, p-value of 0.00166) in additional 29 proteins. Among these are members of the isc-operon (IscA and IscS) and suf-operon (SufB and SufS).

2.7 Biotin Production is not Enhanced in iscR Knockout Mutants

A translational knockout of the iscR gene was introduced into a BW25113 ΔbioB strain by MAGE, by converting the codon encoding glutamic acid on position 22 in iscR (E, GAA) into a stopcodon (*, TGA). Successful conversion of the codon was verified by PCR amplification of the region followed by Sanger sequencing. Strains with genes encoding wild type iscR, iscR knockout (E22*), and mutant iscR (C92Y) were transformed with IPTG-inducible bioB plasmid pBS412, and tested for biotin production in biological replicates (n=3) grown in mMOPS supplemented with 0.1 g/l DTB and 50 µg/l kanamycin at three different IPTG induction levels (0, 0.01, and 0.1 mM) as described above.

No significant differences in biotin production were observed between the iscR knockout (iscR KO) and the wild type iscR (iscR WT) strains when inducing bioB expression by IPTG induction. This provides evidence that knocking out iscR does not improve biotin production. Significant improvement in biotin production was again observed for the mutant iscR encoding IscR C92Y substitution as compared to both iscR WT and iscR KO strains.

2.8 De-Novo Biotin Production is Enhanced in iscR Mutant Strains of the Invention A BW25113 *E. coli* strain from which both the bioA gene and the entire biotin-operon (ΔbioB-bioD) were deleted and comprising either iscR WT, iscR H107Y mutant or iscR C92Y mutant genes, were transformed with a tetracycline resistant plasmid, constitutively overexpressing the native *E. coli* bioA and biotin-operon, with a single point mutation in the bioO operator site (Type 9 mutation, Ifuku et al., 1993). Biotin production was evaluated for the three different strains in biological replicates (n=4) in mMOPS (2 g glucose/l) with 10 μg/ml tetracycline with and without the addition of 0.1 g/l DTB as described above (FIG. 13).

A significant increase in biotin titers were observed for all three strains when the substrate, DTB, was added to the growth medium, indicating that the bioB enzyme reaction itself, converting DTB to biotin, is no longer a bottleneck for biotin production in these strains (FIG. 13). Furthermore, a significant increase in de-novo production of biotin from glucose was observed for both IscR mutant strains as compared to the IscR WT strain. On view of these results it may deduced that the mutant iscR strains of the invention all support enhanced biotin production from both the direct precursor, DTB, and from glucose.

Example 2: Engineering and Characterization of Genetically Modified *E. coli* Strains Capable of Enhanced Lipoic Acid Production The following strains of *Escherichia coli* used in the example are listed below.

TABLE 3

Strains

| Name | Description |
|---|---|
| BS1912 | ΔlipA derived from *E. coli* K-12 BW25113 |
| BS2114 | BS1912 derivate comprising a H107Y mutation in iscR |

The following plasmids used in the example are listed below.

TABLE 4

Plasmids

| Name | Description |
|---|---|
| pBS993 | LipA [SEQ ID No.: 103] overexpression plasmid (kanR, SC101) from a T5 lacO repressed promoter [SEQ ID No.: 234] with additional constitutive expression of AceF [SEQ ID No.: 119] (medium RBS) |
| pBS1037 | pBS993 derivate with p15A origin of replication instead of SC101 and low RBS strength for AceF [SEQ ID No.: 119] expression |
| pBS451 | Constitutively expressed GFP [SEQ ID No.: 287] [zeoR, p15A] |

An IPTG-inducible transgene encoding LipA [SEQ ID No.: 103], cloned on plasmid pBS1037, was introduced into an *E. coli* host strain comprising the native iscR gene or into an *E. coli* host strain in which the native iscR gene was substituted by a mutant iscR gene encoding an IscR protein having an C92Y or H107Y substitution, as described in Example 1; the two strains further comprising a knock-out of the bioB or lipA. The strains were cultured in mMOPS medium (as described in section 1.3) supplemented with 0.1 mM biotin (for ΔbioB strains), IPTG for induction of lipA expression and 0.6 g/l octanoic acid as substrate, for 24 hours at 37° C., before measuring of free lipoic acid in the supernatant. For ΔlipA strains (BS1912 and BS2114, Table 3) growth was followed during the 24 hours of growth at 37° C.

Lipoic acid, produced by cultured cells of the described strains, was measured from the supernatant by means of a bioassay similar to the one described in section 1.6 using BS1912 comprising pBS451. The growth-based bioassay, for quantification of lipoic acid, was performed using an auxotrophic *E. coli* single ΔlipA mutant strain that is incapable of synthesizing lipoic acid (Herbert and Guest, 1975) (BS1912 comprising pBS451). Free lipoic acid concentrations in the supernatant were determined by measuring the growth of the lipoic acid auxotroph strain in a minimal media with 50 nN na-succinate as carbon source, supplemented with lipoic acid recovered from production strains, as the sole source of lipoic acid. A lipoic acid bioassay calibration curve was performed in parallel, where the auxotrophic stain was grown on minimal media, supplemented with a known concentration range of lipoic acid standards.

The tests demonstrate that over-expression of a lipA gene in an *E. coli* strain comprising a gene encoding a mutant form of the IscR protein (IscR protein having an C92Y or H107Y substitution) leads to both a more stable production and an 80% increase in the lipoic acid titer as compared to over-expression of the lipA gene in a parent *E. coli* strain comprising a gene encoding the native form of the IscR protein (FIG. 14). Thus the standard deviation in the production titers of the iscR WT strain (BS1011 with pBS993) is 2.73, whereas it is 1.42 for iscR C92Y (BS1375 with pBS993) and as low as 0.11 for iscR H107Y (BS1353 with pBS993) (see Table 1 for strain references). Based on the average production titers of the individual strains, lipoic acid production is improved 1.79-fold in mutant strains compared to WT strain (see FIG. 14).

Overexpression of LipA showed a clear tendency to reduce the growth rate in response to increased induction of LipA by IPTG (darker shaded grey, FIG. 15) for both WT iscR strain (triangles, BS1912 comprising pBS1037) and iscR mutant strain (squares, BS2114 comprising pBS1037). However, the growth rate for the WT iscR strain was more severely reduced as compared to the mutant iscR strain for all IPTG induction levels tested between 0.01 mM and 0.03 mM (see FIG. 15).

Example 3 Engineering and Characterization of Genetically Modified *E. coli* Strains Capable of Enhanced Thiamine Production The following strains of *Escherichia coli* used in the example are listed below.

TABLE 5

Strains

| Name | Description |
|---|---|
| BS750 | BS1013 derivative, BW25113 ΔthiP and comprising a point mutation in the native thiL gene: codon 133 from GGT to GAG causing G133D substitution in the encoded TMP kinase. |
| BS2019 | BS750 derivative comprising a C92Y mutation in iscR |
| BS2020 | BS750 derivative comprising a H107Y mutation in iscR. |

The following plasmids used in the example are listed below.

TABLE 6

Plasmids

| Name | Description |
|---|---|
| pBS140 | Vector comprising the *E. coli* thiamine pathway genes thiCEFSGHMD; constructed from a combination of the thiC operon (functionally linked to an apFAB46 promoter (SEQ ID No.: 147) and an apFAB377 terminator (SEQ ID No.: 153)) and the thiM operon (functionally linked to an apFAB71 promoter (SEQ ID No.: 149)) and an apFAB378 terminator (SEQ ID No.: 152)). |
| pBS100 | Empty vector used for construction of pBS140 |
| pBS93 | Vector comprising synthetic gene encoding *Arabidopsis thaliana* AT5G32470.1 phosphatase codon optimized for expression in *E. coli* functionally-linked to a pFAB70 promoter (SEQ ID No.: 148) and apFAB381 terminator (SEQ ID No.: 154) |
| pBS209 | Vector based on pBS140 with an additional thiC from *E. coli* |

The thiamine pathway genes thiCEFSGHMD cloned on plasmid pBS140, were introduced into an *E. coli* host strain (BS750) comprising the native iscR gene (as reference strain); as well as into derivatives of this reference strain in which the native iscR gene is substituted by a mutant iscR gene encoding an IscR protein having an C92Y or H107Y substitution respectively (BS2019 and BS2020), as described in Example 1. The strains were cultured in mMOPS medium (as described in section 1.3) for 24 hours at 37° C. in individual wells of a deep culture plate.

Extracellular and intracellular thiamine, TMP and TPP produced by the cultured cells of the described strains, was recovered and extracted as follows: 0.4 mL of each culture were harvested at 4° C. by centrifugation in the cultivation plate at 4000×g for 5 minutes. All remaining steps are performed on ice. 40 µL of supernatant was gently removed for analysis of extracellular TPP, TMP and thiamine. After decanting the remaining supernatant; the culture plate was inverted to remove residual medium and then vortexed. 100 µL ice-cold HPLC grade methanol was added to each well of the culture plate; and the cells were vortexed again. After incubation on ice for a minimum of 20 minutes cell debris was pelleted by centrifugation at 4000×g for 5 minutes. The supernatant was used as intracellular extract for further analysis.

In order to detect TPP, TMP and thiamine using a fluorescence detector, the thiamine compounds produced by each culture were derivatized into thiochromes, which are strongly fluorescent. All steps were performed at room temperature. 40 µl volumes of the extracellular and intracellular extracts was added to 80 µl of 4M potassium acetate and mixed by pipetting. 40 µl of freshly prepared 3.8 mM potassium ferricyanide in 7M NaOH was added and mixed. The reaction was quenched by addition of 40 µl freshly prepared 0.06% $H_2O_2$ in saturated $KH_2PO_4$. The extracts were neutralized by addition of 47 µL 6M HCl and then analyzed by HPLC or direct fluorescence measurement using a Multiskan. All derivatized compounds were quantified using fluorescence standard curves of freshly prepared of TPP, TMP and thiamine standards that are derivatized to thiochromes in parallel with the analyzed extracts.

The tests demonstrate that over-expression of the thiamine pathway genes, which comprise the thiC gene and the thiH gene in combination with a TMP phosphatase gene (At5g32470), in host *E. coli* strains (BS2019 and BS2020) comprising a gene encoding a mutant form of the IscR protein (IscR protein having an C92Y or H107Y substitution) leads to enhanced biosynthesis of thiamine, TMP and TPP, in particular thiamine, as compared to over-expression in host *E. coli* strain (BS750) comprising a gene encoding the native form of the IscR protein.

More specifically, the tests showed an increase of 1.43 fold in OD-normalized extracellular production of thiamines (thiamine, TMP and TPP) between a strain with WT iscR (BS750) and a strain encoding an iscR mutant (BS2020, H107Y or BS2019, C92Y) when using pBS140 (FIG. 16).

Example 4 Overexpression of a Flavodoxin/Ferredoxin Reductase (Fpr) and Flavodoxin (FldA) Reduction System to Increase Productivity of Genetically Modified *E. coli* Strains Capable of Producing Biotin 1 Methods 1.1: The Following Strains of *Escherichia coli* Used in the Examples are Listed Below.

TABLE 7

Strains

| Name | Description |
|---|---|
| BS1013 | *E. coli* K-12 BW25113 parent strain having genotype: rrnB3 ΔlacZ4787 hsdR514 Δ(araBAD)567 Δ(rhaBAD)568 rph-1 |
| BS1011 | ΔbioB (JW0758-1) derived from *E. coli* K-12 BW25113 |
| BS1353 | BS1011 derivative comprising a H107Y mutation in iscR |
| BS1615 | BS1011 derivative with additional deletion of ΔbioAFCD |
| BS1937 | BS1615 derivative comprising pBS679 plasmid giving IPTG - inducible BioB expression |
| BS2185 | BS1615 derivative comprising pBS679 plasmid giving IPTG - inducible BioB expression and pBS1112 giving constitutive FldA-Fpr expression |
| BS2707 | BS1615 derivative comprising pBS679 plasmid giving IPTG - inducible BioB expression and pBS1054 giving constitutive GFP expression |

The following plasmids used in the example are listed below.

TABLE 8

Plasmids

| Name | Description |
|---|---|
| pBS679 | BioB [SEQ ID No.: 22] overexpression plasmid (ampR, pSC101) from a T5 lacO repressed promoter [SEQ ID No: 25] and |
| pBS1054 | GFP [SEQ ID No.: 276] overexpression plasmid (kanR, pBR322) from a constitutive apFAB309 promoter [SEQ ID No.: 291] with an apFAB378 terminator [SEQ ID No.: 292]. |
| pBS1112 | FldA-Fpr overexpression plasmid (kanR, pBR322) from a constitutive apFAB306 promoter (apFAB306-FldA-Fpr gene-apFAB378 terminator [SEQ ID No: 288]) |

An IPTG-inducible transgene encoding BioB was cloned on plasmid pBS679; a constitutively-regulated transgene encoding GFP was cloned on plasmid pBS1054; and a constitutively-regulated transgene comprising a synthetic operon encoding FldA-Fpr was cloned on plasmid pBS1112. pBS679 was introduced into an *E. coli* host strain (BS1615) in which the native iscR gene was substituted by a mutant iscR gene encoding an IscR protein having an H107Y substitution, as described in Example 1, and further comprising a knock-out of the bioAFCD genes resulting in the strain BS1937. The strain BS1937 was then further transformed with either plasmid pBS1054 or pBS1112 resulting in the strains BS2707 (control strain) and BS2185, respectively.

The strains were cultured in mMOPS medium (as described in example 1.3) with appropriate antibiotic(s), 0.1 g/L DTB as substrate for BioB-mediated catalysis, and supplemented with either 0, 0.01, 0.025, 0.05, 0.075 or 0.1 mM IPTG for inducing expression of the BioB gene. The cells were incubated for 24 hours at 37 degrees C. in individual wells of a deep well culture plate. End ODs were estimated, supernatants were harvested by centrifugation and biotin quantified from the supernatants by a biotin bioassay carried out as described in example 1.6.

Figure 12:
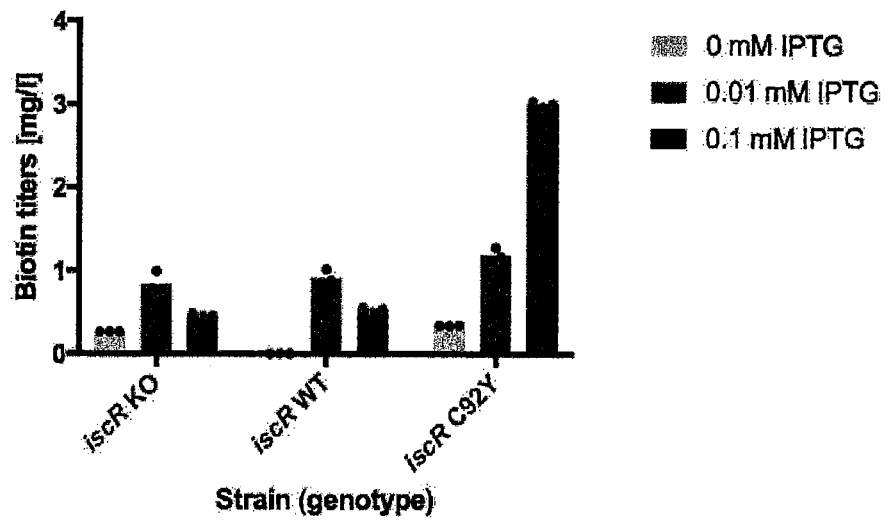
FIG. 12 Bar diagram showing biotin production of *E. coli* ΔbioB strains comprising an IPTG-inducible bioB expression plasmid and either of the following genomic variants of iscR: wild type (iscR WT), knock-out mutant encoding E22* glutamic acid mutated to a stop codon on position 22 (iscR KO), mutant (iscR C92Y) encoding a cysteine to tyrosine substitution at position 92. Bars illustrate the mean biotin production value (height) at given levels of IPTG induction (shade of gray), dots show biotin production from individual replicates. Biological triplicates of each strain were cultured in mMOPS with 100 µg/mL ampicillin under no (0 mM IPTG), low (0.01 mM IPTG) and high (0.1 mM IPTG) induction and providing 0.1 g/L DTB as substrate. Each strain was grown in a deep well plate for 24 hours at 37 degrees C. with 275 rpm, after which biotin production was evaluated using a growth-based bioassay.

As shown in FIG. 12 and FIG. 17 for strain BS1937, when BioB gene expression in *E. coli* cells comprising a genetically modified endogenous iscR gene, are induced with increasing concentrations of IPTG, the cells show a corresponding progressive increase in biotin production. Biotin production in these genetically modified cells is further enhanced by the co-expression of a transgene encoding FldA-Fpr (strain BS2185) when compared with its parent strain BS1937, and with a control strain expressing a transgene encoding GFP instead of FldA-Fpr.

Biotin production of strain BS2185 comprising a gene encoding a mutant form of the IscR protein (IscR protein having an H107Y substitution) and a plasmid for overexpression of BioB (pBS679) and FldA-Fpr genes (pBS1112) is 2.12-fold enhanced compared to the control strain BS1937 (no overexpression of FldA-Fpr genes) (FIG. 18).

REFERENCES

Datsenko K A, Wanner B L (2000) One-step inactivation of chromosomal genes in *Escherichia coli* K-12 using PCR products. Proc Natl Acad Sci USA; 97(12):6640-5.

Fleischhacker, A. S. et al. (2012) Characterization of the [2Fe-2S] cluster of *Escherichia coli* transcription factor IscR. Biochemistry 51: 4453-4462.

Giel, J. L, Rodionov, D., Liu, M., Blattner, F. R. & Kiley, P. J. (2006) IscR-dependent gene expression links iron-sulphur cluster assembly to the control of O2-regulated genes in *Escherichia coli*. Mol. Microbiol. 60, 1058-1075.

Herbert A A, Guest J R. (1975) Lipoic acid content of *Escherichia coli* and other microorganisms. Arch Microbiol.; 106(3):259-66. Epub 1975 Dec. 31. pmid:814874

Ifuku, O. et al. Sequencing analysis of mutation points in the biotin operon of biotin-overproducing *Escherichia coli* mutants. Biosci Biotechnol Biochem 57, 760-765 (1993).

Ifuku, O. et al., (1995) "Molecular analysis of growth inhibition caused by overexpression of the biotin operon in *Escherichia coli*." Bioscience, biotechnology, and biochemistry 59(2):184-189.

Martin, J. E. & Imlay, J. A. (2012) Replication during periods of iron starvation. 80, 319-334.

Py, B. & Barras, F. (2010) Building Fe—S proteins: bacterial strategies. Nat. Rev. Microbiol. 8, 436-446.

Schmitt, A, Kochanowski K., Vedelaar S., Ahrné E., Volkmer B., Callipo L., Knoops K., Bauer M., Aebersold R., & Helnemann M., (2015) The quantitative and condition-dependent *Escherichia coli* proteome. Nature Biotechnology 2015; doi:10.1038

SEQUENCE LISTING (292 sequences)

SEQ ID NO: 1 - DNA, 489 bp, Escherichia coli
  CDS (1)..(489): iscR WT gene encoding Iron Sulfur Cluster Regulator protein (IscR)
atgagactgacatctaaagggcgctatgccgtgaccgcaatgcttgacgttgcgctcaactctgaagcgggcccggtaccgttggctgatatttccgaacgtcagggaatttccctttcttatctggaacaactgttttcccgtctgcgtaaaaatggtctggtttccagcgtacgtggaccaggcggtggttatctgttaggcaaagatgccagcagcatcgccgttggcgaagtaattagcgccgttgacgaatctgtagatgccacccgttgtcagggtaaaggcggctgccagggcggcgataaatgcctgacccacgcgctgtggcgtgatttgagcgaccgtctcaccggttttctcaacaacattactttaggcgaactggttaataaccaggaagtgctggatgtgtctggtcgtcagcatactcacgacgcgccacgcacccgcacacaagacgcgatcgacgttaagttacgcgcttaa

SEQ ID NO: 2 - protein, 162 aa, Escherichia coli
MRLTSKGRYAVTAMLDVALNSEAGPVPLADISERQGISLSYLEQLFSRLRKNGLVSSVRGPGGGYLLGKDASSIAVGEVISAVDESVDATRCQGKGGCQGGDKCLTHALWRDLSDRLTGFLNNITLGELVNNQEVLDVSGRQHTHDAPRTRTQDAIDVKLRA

SEQ ID NO: 3 - DNA, 486 bp, Shigella sonnei
  CDS (1)..(486): iscR gene encoding Iron Sulfur Cluster Regulator
atgcgcctgaccagcaaaggccgctatgcggtgaccgcgatgctggatgtggcgctgaacagcgaagcgggcccggtgccgctggcggatattagcgaacgccagggcattagcctgagctatctggaacagctgtttagccgcctgcgcaaaaacggcctggtgagcagcgtgcgcggcccgggcggcggctatctgctgggcaaagatgcgagcagcattgcggtgggcgaagtgattagcgcggtggatgaaagcgtggatgcgacccgctgccagggcaaaggcggctgccagggcggcgataaatgcctgacccatgcgctgtggcgcgatctgagcgatcgcctgaccggctttctgaacaacattaccctgggcgaactggtgaacaaccaggaagtgctggatgtgagcggccgccagcatacccatgatgcgccgcgcacccgcattctggatgcgattgatgtgaaactgcgcgcg

SEQ ID NO: 4 - protein, 162 aa, Shigella sonnei
MRLTSKGRYAVTAMLDVALNSEAGPVPLADISERQGISLSYLEQLFSRLRKNGLVSSVRGPGGGYLLGKDASSIAVGEVISAVDESVDATRCQGKGGCQGGDKCLTHALWRDLSDRLTGFLNNITLGELVNNQEVLDVSGRQHTHDAPRTRILDAIDVKLRA

SEQ ID NO: 5 - DNA, 489 bp, Citrobacter pasteurii
  CDS (1)..(489): iscR gene encoding Iron Sulfur Cluster Regulator
atgcgcctgaccagcaaaggccgctatgcggtgaccgcgatgctggatgtggcgctgaacagcgaaaccggcccggtgccgctggcggatattagcgaacgccagggcattagcctgagctatctggaacagctgtttagccgcctgcgcaaaaacggcctggtgagcagcgtgcgcggcccgggcggcggctatctgctgggcaaagatgcgagcagcattgcggtgggcgaagtgattagcgcggtggatgaaagcgtggatgcgacccgctgccagggcaaaggcggctgccagggcggcgataaatgcctgacccatgcgctgtggcgcgatctgagcgatcgcctgaccggctttctgaacaacattaccctgggcgaactggtgaacaaccaggaagtgctggatgtgagcggccgccagcatacccatgatgcgccgcgcaccaaccgcgcgcaggatgcgattgatgtgaaactgcgcgcg

SEQ ID NO: 6 - protein, 163 aa, Citrobacter pasteurii
MRLTSKGRYAVTAMLDVALNSETGPVPLADISERQGISLSYLEQLFSRLRKNGLVSSVRGPGGGYLLGKDASSIAVGEVISAVDESVDATRCQGKGGCQGGDKCLTHALWRDLSDRLTGFLNNITLGELVNNQEVLDVSGRQHTHDAPRTNRAQDAIDVKLRA

SEQ ID NO: 7 - DNA, 489 bp, Enterobacter timonensis
  CDS (1)..(489): iscR gene encoding Iron Sulfur Cluster Regulator
atgcgcctgaccagcaaaggccgctatgcggtgaccgcgatgctggatgtggcgctgaacagcgaagcgggcccggtgccgctggcggatattagcgaacgccagggcattagcctgagctatctggaacagctgtttagccgcctgcgcaaaaacggcctggtgagcagcgtgcgcggcccgggcggcggctatctgctgggcaaagatgcgggcagcattgcggtgggcgaagtgattagcgcggtggatgaaagcgtggatgcgacccgctgccagggcaaaggcggctgccagggcggcgataaatgcctgacccatgcgctgtggcgcgatctgagcgatcgcctgaccggctttctgaacaacattaccctgggcgaactggtgaacaaccaggaagtgctggatgtgagcggccgccagcatagccatgatagccagcgcaacacccgcgcgcaggatgcgattgatgtgaaactgcgcgcg

SEQ ID NO: 8 - protein, 163 aa, Enterobacter timonensis
MRLTSKGRYAVTAMLDVALNSEAGPVPLADISERQGISLSYLEQLFSRLRKNGLVSSVRGPGGGYLLGKDAGSIAVGEVISAVDESVDATRCQGKGGCQGGDKCLTHALWRDLSDRLTGFLNNITLGELVNNQEVLDVSGRQHSHDSQRNTRAQDAIDVKLRA

SEQ ID NO: 9 - DNA, 489 bp, Pluralibacter gergoviae
  CDS (1)..(489): iscR gene encoding Iron Sulfur Cluster Regulator
atgcgcctgaccagcaaaggccgctatgcggtgaccgcgatgctggatgtggcgctgaacagcgaaagcggcccggtgccgctggcggatattagcgaacgccagggcattagcctgagctatctggaacagctgtttagccgcctgcgcaaaaacggcctggtgagcagcgtgcgcggcccgggcggcggctatctgctgggcaaagatgcgggcagcattgcggtgggcgaagtgattagcgcggtggatgaaagcgtggatgcgacccgctgccagggcaaagcgggctgccagggcggcgataaatgcctgacccatgcgctgtggcgcgatctgagcgatcgcctgaccggctttctgaacaacattaccctgggcgaactggtgaacaaccaggaagtgctggatgtgagcgatcgccagcatattcatgaaacccagcgcagcacccgcagccaggatgcgattgatgtgaaactgcgcgcg

SEQ ID NO: 10 - protein, 163 aa, Pluralibacter gergoviae
MRLTSKGRYAVTAMLDVALNSESGPVPLADISERQGISLSYLEQLFSRLRKNGLVSSVRGPGGGYLLGKDAGSIAVGEVISAVDESVDATRCQGKAGCQGGDKCLTHALWRDLSDRLTGFLNNITLGELVNNQEVLDVSDRQHIHETQRSTRSQDAIDVKLRA

SEQ ID NO: 11 - DNA, 486 bp, Buttiauxella sp.
  CDS (1)..(486): iscR gene encoding Iron Sulfur Cluster Regulator
atgcgcctgaccagcaaaggccgctatgcggtgaccgcgatgctggatgtggcgctgaacagcgaaagcggcccggtgccgctggcggatattagcgaacgccagggcattagcctgagctatctggaacagctgtttagccgcctgcgcaaaaacggcctggtggcgagcgtgcgcggcccgggcggcggctatctgctgggcaaagaagcgagcgcgattgcggtgggcgaagtgattagcgcggtggatgaaagcgtggatgcgacccgctgcgcgggcaaaggcggctgccagggcggcgataaatgcctgacccatgcgctgtggcgcgatctgagcgatcgcctgaccggctttctgaacaacattaccctgggcgaactggtgaacaaccaggaagtgctggatgtgagcggccgccagcataacgaaaaccatcgcagcacccgcagccaggatgcgattgatgtgaaactgcgcgcg

SEQ ID NO: 12 - protein, 162 aa, Buttiauxella sp.
MRLTSKGRYAVTAMLDVALNSESGPVPLADISERQGISLSYLEQLFSRLRKNGLVASVRGPGGGYLLGKEASAIAVGEVISAVDESVDATRCAGKGGCQGGDKCLTHALWRDLSDRLTGFLNNITLGELVNNQEVLDVSGRQHNENHRSTRSQDAIDVKLRA

SEQ ID NO: 13 - DNA, 489 bp, Kosakonia sacchari
  CDS (1)..(489): iscR gene encoding Iron Sulfur Cluster Regulator
atgcgcctgaccagcaaaggccgctatgcggtgaccgcgatgctggatgtggcgctgaacagcgaagcgggcccggtgccgctggcggatattagcgaacgccagggcattagcctgagctatctggaacagctgtttagccgcctgcgcaaaaacggcctggtggcgagcgtgcgcggcccgggcggcggctatctgctgggcaaagatgcgaacaccattgcggtgggcgaagtgattagcgcggtggatgaaagcgtggatgcgacccgctgccagggcaaaagcggctgccagggcggcgataaatgcctgacccatgcgctgtggcgcgatctgagcgatcgcctgaccggctttctgaacaacattaccctgggcgaactggtgaacaaccaggaaattctggatgtgagcgatcgccagcataacaacgaaagccatcgcaacacccgcggccaggatgcgattgatgtgaaactgcgcgcg

SEQ ID NO: 14 - protein, 163 aa, Kosakonia sacchari
MRLTSKGRYAVTAMLDVALNSEAGPVPLADISERQGISLSYLEQLFSRLRKNGLVASVRGPGGGYLLGKDANTIAVGEVISAVDESVDATRCQGKSGCQGGDKCLTHALWRDLSDRLTGFLNNITLGELVNNQEILDVSDRQHNNESHRNTRGQDAIDVKLRA

SEQ ID NO: 15 - DNA, 489 bp, Escherichia coli
  CDS (1)..(489): iscR mutant gene encoding Iron Sulfur Cluster Regulator protein (IscR) with L15F substitution
atgagactgacatctaaagggcgctatgccgtgaccgcaatgtttgacgttgcgctcaactctgaagcgggcccggtaccgttggctgatatttccgaacgtcagggaatttccctttcttatctggaacaactgttttcccgtctgcgtaaaaatggtctggtttccagcgtacgtggaccaggcggtggttatctgttaggcaaagatgccagcagcatcgccgttggcgaagtaattagcgccgttgacgaatctgtagatgccacccgttgtcagggtaaaggcggctgccagggcggcgataaatgcctgacccacgcgctgtggcgtgatttgagcgaccgtctcaccggttttctcaacaacattactttaggcgaactggttaataaccaggaagtgctggatgtgtctggtcgtcagcatactcacgacgcgccacgcacccgcacacaagacgcgatcgacgttaagttacgcgcttaa

SEQ ID NO: 16 - protein, 162 aa, Escherichia coli
MRLTSKGRYAVTAMFDVALNSEAGPVPLADISERQGISLSYLEQLFSRLRKNGLVSSVRGPGGGYLLGKDASSIAVGEVISAVDESVDATRCQGKGGCQGGDKCLTHALWRDLSDRLTGFLNNITLGELVNNQEVLDVSGRQHTHDAPRTRTQDAIDVKLRA

SEQ ID NO: 17 - DNA, 489 bp, Escherichia coli
  CDS (1)..(489): iscR mutant gene encoding Iron Sulfur Cluster Regulator protein (IscR) with C92Y substitution
atgagactgacatctaaagggcgctatgccgtgaccgcaatgcttgacgttgcgctcaactctgaagcgggcccggtaccgttggctgatatttccgaacgtcagggaatttccctttcttatctggaacaactgttttcccgtctgcgtaaaaatggtctggtttccagcgtacgtggaccaggcggtggttatctgttaggcaaagatgccagcagcatcgccgttggcgaagtaattagcgccgttgacgaatctgtagatgccacccgttatcagggtaaaggcggctgccagggcggcgataaatgcctgacccacgcgctgtggcgtgatttgagcgaccgtctcaccggttttctcaacaacattactttaggcgaactggttaataaccaggaagtgctggatgtgtctggtcgtcagcatactcacgacgcgccacgcacccgcacacaagacgcgatcgacgttaagttacgcgcttaa

SEQ ID NO: 18 - protein, 162 aa, Escherichia coli
MRLTSKGRYAVTAMLDVALNSEAGPVPLADISERQGISLSYLEQLFSRLRKNGLVSSVRGPGGGYLLGKDASSIAVGEVISAVDESVDATRYQGKGGCQGGDKCLTHALWRDLSDRLTGFLNNITLGELVNNQEVLDVSGRQHTHDAPRTRTQDAIDVKLRA

SEQ ID NO: 19 - DNA, 489 bp, Escherichia coli
  CDS (1)..(489): iscR mutant gene encoding Iron Sulfur Cluster Regulator protein (IscR) with H107Y substitution
atgagactgacatctaaagggcgctatgccgtgaccgcaatgcttgacgttgcgctcaactctgaagcgggcccggtaccgttggctgatatttccgaacgtcagggaatttccctttcttatctggaacaactgttttcccgtctgcgtaaaaatggtctggtttccagcgtacgtggaccaggcggtggttatctgttaggcaaagatgccagcagcatcgccgttggcgaagtaattagcgccgttgacgaatctgtagatgccacccgttgtcagggtaaaggcggctgccagggcggcgataaatgcctgacctacgcgctgtggcgtgatttgagcgaccgtctcaccggttttctcaacaacattactttaggcgaactggttaataaccaggaagtgctggatgtgtctggtcgtcagcatactcacgacgcgccacgcacccgcacacaagacgcgatcgacgttaagttacgcgcttaa

SEQ ID NO: 20 - protein, 162 aa, Escherichia coli
MRLTSKGRYAVTAMLDVALNSEAGPVPLADISERQGISLSYLEQLFSRLRKNGLVSSVRGPGGGYLLGKDASSIAVGEVISAVDESVDATRCQGKGGCQGGDKCLTYALWRDLSDRLTGFLNNITLGELVNNQEVLDVSGRQHTHDAPRTRTQDAIDVKLRA

SEQ ID NO: 21 - DNA, 1041 bp, Escherichia coli
  CDS (1)..(1041): bioB gene encoding biotin synthase (EC 2.8.1.6)
atggctcaccgcccacgctggacattgtcgcaagtcacagaattatttgaaaaaccgttgctggatctgctgtttgaagcgcagcaggtgcatcgccagcatttcgatcctcgtcaggtgcaggtcagcacgttgctgtcgattaagaccggagcttgtccggaagattgcaaatactgcccgcaaagctcgcgctacaaaaccgggctggaagccgagcggttgatggaagttgaacaggtgctggagtcggcgcgcaaagcgaaagcggcaggatcgacgcgcttctgtatgggcgcggcgtggaagaatccccacgaacgcgatatgccgtacctggaacaaatggtgcagggggtaaaagcgatggggctggaggcgtgtatgacgctgggcacgttgagtgaatctcaggcgcagcgcctcgcgaacgccgggctggattactacaaccacaacctggacacctcgccggagttttacggcaatatcatcaccacacgcacttatcaggaacgcctcgatacgctggaaaaagtgcgcgatgccgggatcaaagtctgttctggcggcattgtgggcttaggcgaaacggtaaaagatcgcgccggattattgctgcaactggcaaacctgccgacgccgccggaaagcgtgccaatcaacatgctggtgaaggtgaaaggcacgccgcttgccgataacgatgatgtcgatgcctttgattttattcgcaccattgcggtcgcgcggatcatgatgccaacctcttacgtgcgcctttctgccggacgcgagcagatgaacgaacagactcaggcgatgtgctttatggcaggcgcaaactcgattttctacggttgcaaactgctgaccacgccgaatccggaagaagataaagacctgcaactgttccgcaaactggggctaaatccgcagcaaactgccgtgctggcaggggataacgaacaacagcaacgtcttgaacaggcgctgatgaccccggacaccgacgaatattacaacgcggcagcattatga

SEQ ID NO: 22 - protein, 346 aa, Escherichia coli
MAHRPRWTLSQVTELFEKPLLDLLFEAQQVHRQHFDPRQVQVSTLLSIKTGACPEDCKYCPQSSRYKTGLEAERLMEVEQVLESARKAKAAGSTRFCMGAAWKNPHERDMPYLEQMVQGVKAMGLEACMTLGTLSESQAQRLANAGLDYYNHNLDTSPEFYGNIITTRTYQERLDTLEKVRDAGIKVCSGGIVGLGETVKDRAGLLLQLANLPTPPESVPINMLVKVKGTPLADNDDVDAFDFIRTIAVARIMMPTSYVRLSAGREQMNEQTQAMCFMAGANSIFYGCKLLTTPNPEEDKDLQLFRKLGLNPQQTAVLAGDNEQQQRLEQALMTPDTDEYYNAAAL

SEQ ID NO: 23 - DNA, 1040 bp, Escherichia coli
  CDS (1)..(222): Mutant bioB gene with frameshift  encoding inactive truncated biotin synthase (EC 2.8.1.6)
atggccaccgcccacgctggacattgtcgcaagtcacagaattatttgaaaaaccgttgctggatctgctgtttgaagcgcagcaggtgcatcgccagcatttcgatcctcgtcaggtgcaggtcagcacgttgctgtcgattaagaccggagcttgtccggaagattgcaaatactgcccgcaaagctcgcgctacaaaaccgggctggaagccgagcggttgatggaagttgaacaggtgctggagtcggcgcgcaaagcgaaagcggcaggatcgacgcgcttctgtatgggcgcggcgtggaagaatccccacgaacgcgatatgccgtacctggaacaaatggtgcagggggtaaaagcgatggggctggaggcgtgtatgacgctgggcacgttgagtgaatctcaggcgcagcgcctcgcgaacgccgggctggattactacaaccacaacctggacacctcgccggagttttacggcaatatcatcaccacacgcacttatcaggaacgcctcgatacgctggaaaaagtgcgcgatgccgggatcaaagtctgttctggcggcattgtgggcttaggcgaaacggtaaaagatcgcgccggattattgctgcaactggcaaacctgccgacgccgccggaaagcgtgccaatcaacatgctggtgaaggtgaaaggcacgccgcttgccgataacgatgatgtcgatgcctttgattttattcgcaccattgcggtcgcgcggatcatgatgccaacctcttacgtgcgcctttctgccggacgcgagcagatgaacgaacagactcaggcgatgtgctttatggcaggcgcaaactcgattttctacggttgcaaactgctgaccacgccgaatccggaagaagataaagacctgcaactgttccgcaaactggggctaaatccgcagcaaactgccgtgctggcaggggataacgaacaacagcaacgtcttgaacaggcgctgatgaccccggacaccgacgaatattacaacgcggcagcattatga

SEQ ID NO: 24 - protein, 74 aa, Escherichia coli
MATAHAGHCRKSQNYLKNRCWICCLKRSRCIASISILVRCRSARCCRLRPELVRKIANTARKARATKPGWKPSG

SEQ ID NO: 25 - DNA, 97 bp, Escherichia coli
  promoter (1)..(97): T5 lacO repressed promoter
tcataaaaaatttatttgctttgtgagcggataacaattataatagattcaaatcggaggttctctaactagtatctctagagctaaggaggtaaat

SEQ ID NO: 26 - DNA, 1041 bp, Candidatus Chloracidobacterium thermophilum B
  CDS (1)..(1041): bioB gene encoding biotin synthase from Candidatus Chloracidobacterium thermophilum B
atgagccagccgctggttcgttttgattggacccgtgatgaactgcgtgcactgcatgatctgccgctgctggaactgattcatcgtgcagcaaccgttcatcgtacctgtcatgatccgcaggaagttcaggtttgtcgtctgattagcattaaaaccggcggttgtccggaagattgtggttattgtagccagagcgcacattatgaaaccggtattgcagcacagccgctgctggataaagccaccgttgttgcaattgcagaacgtgcaaaagcacatggtgttagccgtgtttgtctgggtgcagcatggcgtaatgttcgtgatgatgcacagtttgaagcagttctggatattgttcgtagcgttaatgcactgggtattgaagtttgttgtaccctgggtatgctgaccgaagcccaggcacgtcgtctggaagaagcaggtctgtatgcatataatcataatctggataccagccgtgaatattatggtcgtgttgttaccacccgtacctatgatgatcgcctggaaaccctggcaaatgttcgcaaaaccggtgttaccctgtgtaccggtggtattctgggtctgggtgaaagcaccgatgatcgtattggtctgctgcataccctggccaccatgaatccgcatccggaaagcgttccgattaatctgctgacccgtgttccgggtaccccgatggaaaatgaagcagaagttagcgtttgggaaaccctgcgtgttattgcaaccgcacgtattgcaatgccgcgtagtgttattcgtctgagcgcaggtcgtacccagctgagcgaagaagcacaggcactgtgttttctggccggtgcaaatagcatttttagcagcgatgcacgtatgatgctgacccgcgttagcccgaccaatgattatgatgaagatgcccagctgctgaataaactgggtctgcatccgcgtgttccgtttaaagatgcaccgaatgcaaaaaccgcaggttgtgcaagcgcagccaccgcaaccctgcaggaaaaataa

SEQ ID NO: 27 - protein, 346 aa, Candidatus Chloracidobacterium thermophilum B
MSQPLVRFDWTRDELRALHDLPLLELIHRAATVHRTCHDPQEVQVCRLISIKTGGCPEDCGYCSQSAHYETGIAAQPLLDKATVVAIAERAKAHGVSRVCLGAAWRNVRDDAQFEAVLDIVRSVNALGIEVCCTLGMLTEAQARRLEEAGLYAYNHNLDTSREYYGRVVTTRTYDDRLETLANVRKTGVTLCTGGILGLGESTDDRIGLLHTLATMNPHPESVPINLLTRVPGTPMENEAEVSVWETLRVIATARIAMPRSVIRLSAGRTQLSEEAQALCFLAGANSIFSSDARMMLTRVSPTNDYDEDAQLLNKLGLHPRVPFKDAPNAKTAGCASAATATLQEK

SEQ ID NO: 28 - DNA, 1164 bp, Streptomyces lydicus
  CDS (1)..(1164): bioB gene encoding biotin synthase from Streptomyces lydicus A02
atgccgtatgttcgtattaatgcaatggatctgctgaataccctggttgataaaggtctgcgtcgtgaactgccgacccgtgaagaagcactggcagttctggcaaccagcgatgatgaactgctggatgttgttgcagcagcgggtaaagttcgccgtcagtggtttggtcgtcgtgttaaactgaattatctggtgaatctgaaaagcggtctgtgtccggaagattgtagctattgtagccagcgtctgggtagcaaagcagaaattctgaaatatacctggctgaaaccggatgatgcaagtaaagcagccgcagcaggcgttgccggtggtgcaaaacgtgtttgtctggttgcaagcggtcgtggtccgaccgataaagatgttgatcgtgtgagcgaaaccattagcgcaattaaagaacagaatgaaggtgtggaagtttgtgcatgtctgggtctgctgagcgatggtcaggcagatcgtctgcgtgcagccggtgcagatgcatataatcataatctgaataccagtgaagcaacctatggtgatatttgtaccacccatgattttagcgatcgtgttagcaccgttcagcaggcacaggcagcaggtatgagcgcatgtagcggtctgattgcaggtatgggtgaaagcgatgcagatctggtggatgtggtttttgcactgcgtgaactggatccggatagcgttccggttaattttctgattccgtttgaaggtaccccgctggcaaaagaatggaatctgaccccgcagcgtgccctgcgtattctggcaatggttcgttttgtttgtccggatgttgaagttcgtctggcaggcggtcgtgaagttcatctgcgtagcctgcagccgctggcactgcatctggttaatagcatttttctgggtgattatctgaccagcgaaggtcaggccggtaaagaagatctggccatgattgccgatgcaggttttgaagtggaaggtacagataccaccaccctgccggaacatcgtacagatgctgcagttcagccggcaccggaaccggcagcagatgcagcagttcctgcacctcctagtgaagaaacacgtcgtgatctggttagcgttcgtcgtcgtggtgcaggtaccgaactgccgccgaatgcataa

SEQ ID NO: 29 - protein, 387 aa, Streptomyces lydicus
MPYVRINAMDLLNTLVDKGLRRELPTREEALAVLATSDDELLDVVAAAGKVRRQWFGRRVKLNYLVNLKSGLCPEDCSYCSQRLGSKAEILKYTWLKPDDASKAAAAGVAGGAKRVCLVASGRGPTDKDVDRVSETISAIKEQNEGVEVCACLGLLSDGQADRLRAAGADAYNHNLNTSEATYGDICTTHDFSDRVSTVQQAQAAGMSACSGLIAGMGESDADLVDVVFALRELDPDSVPVNFLIPFEGTPLAKEWNLTPQRALRILAMVRFVCPDVEVRLAGGREVHLRSLQPLALHLVNSIFLGDYLTSEGQAGKEDLAMIADAGFEVEGTDTTTLPEHRTDAAVQPAPEPAADAAVPAPPSEETRRDLVSVRRRGAGTELPPNA

SEQ ID NO: 30 - DNA, 975 bp, Paracoccus denitrificans
  CDS (1)..(975): bioB gene encoding biotin synthase from Paracoccus denitrificans PD1222
atgattcgtaccgattggacaatggcagaagcatgggcaattcatgcactgccgtttgcagatctgatgcatcgcgcacagaccctgcatcgtgcacattttgatccgaatgcaattgaaaccgcaagcctgctgagcattaaaaccggtggttgtccggaagattgtggttattgtagccagagcgcacatcatgataccggtgttaaagcaaccaaactgatgggtaccgaagaagttctggcagcagcacgtcgtgcaaaagcaagcggtgcacagcgtttttgtatgggtgcagcatggcgtagcccgaaagatcgtgatatggataaactgtgtgatatggttcgtggtgttgcagaactgggtctggaaacctgtatgaccctgggtatgctgagcccggaacaggttgcacgtctgaaagcagcaggtctggatttttataatcataatattgataccagcccggaatattatgcccagattgccagcacccgtacaatggaaaatcgtctggataccgttgaacaggttcgtaaaggtggtattaaagtttgttgtggtggtattctgggtatgggtgaagcagaagaagatcgtattgcaatgctggttaccctggcaaccctgccggcacatccggatagcgttccggttaatctgtggaatgaaattgaaggtgttccggttcaggcacgtgcacaggcagttgatccgtttgccctggttcgtattgttgcactggcacgtattctgatgccggcaagcgttgttcgtctgagcgcaggtcgtaccggtatgagcgatgaactgcaggcactgtgttttctggcgggtgcaaatagcatttttgttggtgatcagctgctgaccaccggtaatccggcagcatggaaagatcaggatctgctgagtcgtctgggtatgcatattgcaccggcacaggcccgtccgcgtgttgcagcagaataa

SEQ ID NO: 31 - protein, 324 aa, Paracoccus denitrificans
MIRTDWTMAEAWAIHALPFADLMHRAQTLHRAHFDPNAIETASLLSIKTGGCPEDCGYCSQSAHHDTGVKATKLMGTEEVLAAARRAKASGAQRFCMGAAWRSPKDRDMDKLCDMVRGVAELGLETCMTLGMLSPEQVARLKAAGLDFYNHNIDTSPEYYAQIASTRTMENRLDTVEQVRKGGIKVCCGGILGMGEAEEDRIAMLVTLATLPAHPDSVPVNLWNEIEGVPVQARAQAVDPFALVRIVALARILMPASVVRLSAGRTGMSDELQALCFLAGANSIFVGDQLLTTGNPAAWKDQDLLSRLGMHIAPAQARPRVAAE

SEQ ID NO: 32 - DNA, 963 bp, Paracoccus denitrificans
  CDS (1)..(963): bioB gene encoding biotin synthase from Paracoccus denitrificans PD1222(2)
atgccgcagcagagccgtagcgcagcagaaatttatcatcagccgctgatggatctgctgtttcaggcacagaccgttcatcgtgcacattttgatccgaatgttgttcagtgtagcaaactgctgagcattaaaaccggtggttgtccggaagattgtgcatattgtagccagagcgcacgtaatggtagcgaactgagcgcaagcaaactgatggaagttcagcgtgttctggcagaagcacgtcgtgcaaaagaagccggtgcaacccgttattgtatgggtgcagcatggcgtagcccgaaagaacgtgatatgccggcagttctggcaatgattcgtggtgttaaagcaatgggtatggaaacctgtatgaccctgggtatgctggatgcagatcaggcactgcgtctgaaagatgccggtctggattattataaccataatattgataccagcgaacgctattatagcgaaattattaccacccgcacctttcaggatcgcattgaaaccctggaacgtgttcaggcagcaggtattaatgtttgtgccggtggtattgttggtatgggtgaaaccgcagaagatcgtattagcatgctggaaaccctggcaggtctggaagtgccgccgcagagcgttccgattaatatgctgatgccgatggcaggtaccccgctggcagatgttccgcgtctggatgcaattgaaatggttcgtaccattgcaaccgcacgtattctgatgccggcaagctatgttcgtctgagcgcaggtcgtagcgaaatgagcgatgaaatgcaggcaatgtgtttttttgcaggcgcaaatagcatttttgttggtgataccctgctgaccgcaggtaatccggatgaagataaagatgcactgctgtttgcaaaactgggtctgcgtgcagaagttccggaagcaagccaggaaggttgtgcagcataa

SEQ ID NO: 33 - protein, 320 aa, Paracoccus denitrificans
MPQQSRSAAEIYHQPLMDLLFQAQTVHRAHFDPNVVQCSKLLSIKTGGCPEDCAYCSQSARNGSELSASKLMEVQRVLAEARRAKEAGATRYCMGAAWRSPKERDMPAVLAMIRGVKAMGMETCMTLGMLDADQALRLKDAGLDYYNHNIDTSERYYSEIITTRTFQDRIETLERVQAAGINVCAGGIVGMGETAEDRISMLETLAGLEVPPQSVPINMLMPMAGTPLADVPRLDAIEMVRTIATARILMPASYVRLSAGRSEMSDEMQAMCFFAGANSIFVGDTLLTAGNPDEDKDALLFAKLGLRAEVPEASQEGCAA

SEQ ID NO: 34 - DNA, 987 bp, Agrobacterium vitis
  CDS (1)..(987): bioB gene encoding biotin synthase from Agrobacterium vitis S4
atgagcgaagcagccggtgaaattcgtaatgattggagcgttgaagaaattgtgaccctgcataatctgccgctgctggaactgattggtcatgcaaatgcagttcatggtcgtcatcataatccgaatgttgttcagaaagcaagcctgctgagcattaaaaccggtggttgtccggaagattgtgcatattgtccgcagagcgcacatcatcgtgaagttaaactgaccaaagatcgtctgatgcagccggaaaccgttctggcactggcaaaacgtgcaaaagatgccggtgcagaacgtttttgtatgggtgcagcatggcgtcaggttcgtgatggtaaagaatttgatgcagttctgacaatggttcgtggtgtgcgtgatctgggtatggaagcatgtgttaccctgggtatgctggaaaaacatcaggccgaaaaactggcagaagcaggtctgaccgcatataatcataatctggataccagcccggaattttatggcgaaattattaccacccgtagctatgcagatcgtctggaaaccctgagcattgttcgtagctttggtattgatctgtgttgtggtggtattattggtatgggtgaaaccattcgtgatcgtgcaagtatgctgcaggttctggcaagcatgcgtccgcatccggaaagtgttccgattaatgcactggttccggttgaaggtaccccgctggcagcaatgccgcgtattgatccgctggaactggttcgtatggttgcaaccgcacgtattgttatgccgaaaagcaccgttcgtctgagcgcaggtcgtagcaccctgaatcgtgaagcacagattctgtgtctggttagcggtgcaaatagcgttttttatggtgataccctgctgaccaccccgaatgcaggtattggtgaagatgaagcactgtttgcagcaattggtgcactgccgcatgaagcagcaccgctggccgcagaataa

SEQ ID NO: 35 - protein, 328 aa, Agrobacterium vitis
MSEAAGEIRNDWSVEEIVTLHNLPLLELIGHANAVHGRHHNPNVVQKASLLSIKTGGCPEDCAYCPQSAHHREVKLTKDRLMQPETVLALAKRAKDAGAERFCMGAAWRQVRDGKEFDAVLTMVRGVRDLGMEACVTLGMLEKHQAEKLAEAGLTAYNHNLDTSPEFYGEIITTRSYADRLETLSIVRSFGIDLCCGGIIGMGETIRDRASMLQVLASMRPHPESVPINALVPVEGTPLAAMPRIDPLELVRMVATARIVMPKSTVRLSAGRSTLNREAQILCLVSGANSVFYGDTLLTTPNAGIGEDEALFAAIGALPHEAAPLAAE

SEQ ID NO: 36 - DNA, 957 bp, Ruegeria pomeroyi
  CDS (1)..(957): bioB gene encoding biotin synthase from Ruegeria pomeroyi DSS-3
atggccgaagcaattcgtagcgattggagcgttgatgaagttgaagcactgctgcgtctgccgctgctggatctggttggtcgtgcaaatggtgttcatcgtgcacatcatgcaccggatgatattcagaaagcaagcctgctgagcattaaaaccggtggttgtccggaagattgtgcatattgcccgcagagcgcacatcatcgtgaagtggaactgacccgtgaaaaactgatgaatccggatcatgttgttagcctggcacgtcgtgcccagcgtgccggtgccgaacgtttttgtatgggtgcagcatggcgtcaggttcgtgatggtgcagaatttgataatgttctggcaatggttcgtggtgttcgtgcactgggtatggaagcatgtgttaccctgggtatgctgcgtccgcatcaggcacagcgtctggcagaagcaggtctgaccgcatataatcataatctggataccagcccggaattttatggtcagattattggtacccgtacctatcaggatcgtctggataccctggcatattgtcgtgatgcaggtattgaactgtgttgtggtggtattattggcatgggtgaaagcctgcgtgatcgtgcagcaatgctgcaggttctggccaattttgcaccgcatccggaaagcgttccgattaatgcactgattccgattgaaggtaccccgctggcacatcgtgaacgtgttggtatttttgatctggttcgtatggttgcaaccgcacgtattattatgccgctgacccgtgttcgtctgagcgcaggtcgtagtgattttagcgccgcagaacaggcactgtgttttctggcgggtgcaaatagcgttttttatggtgatgttctgctgaccgcaccgaatgcaggtaccggtgcagatgcagaactgtttgcagcactgggtgcactggaaaccgcataa

SEQ ID NO: 37 - protein, 318 aa, Ruegeria pomeroyi
MAEAIRSDWSVDEVEALLRLPLLDLVGRANGVHRAHHAPDDIQKASLLSIKTGGCPEDCAYCPQSAHHREVELTREKLMNPDHVVSLARRAQRAGAERFCMGAAWRQVRDGAEFDNVLAMVRGVRALGMEACVTLGMLRPHQAQRLAEAGLTAYNHNLDTSPEFYGQIIGTRTYQDRLDTLAYCRDAGIELCCGGIIGMGESLRDRAAMLQVLANFAPHPESVPINALIPIEGTPLAHRERVGIFDLVRMVATARIIMPLTRVRLSAGRSDFSAAEQALCFLAGANSVFYGDVLLTAPNAGTGADAELFAALGALETA

SEQ ID NO: 38 - DNA, 1020 bp, Agrobacterium fabrum
  CDS (1)..(1020): bioB gene encoding biotin synthase from Agrobacterium fabrum str. C58
atggatcagctggcaacccagattgatggtaaaccggcaagcattccggcagttgaaaccagcagcagcctggaagaagccaaaattatttataatctgccgtttaatgatctgctgtttcgcgcccagcaggttcatcgttgtcattttgatgccaatgcaattcagatgagccgtctgctgagcattaaaaccggcggttgtccggaagattgtagctattgtagccagagcgcacgtaatccgaccggtctgaaagcaagcaaactgatggaagttgaacgtgttctggcagaagcacgtaaagcaaaagaaggtggtgcaacccgttattgtatgggtgcagcatggcgtaatccgaaagaacgtgatatggaagcagttgttgcaatggttgaaggtgttaaagcactggatatggaaacctgtatgaccctgggtatgctgaccccggaacagagcgaacgtctggcagatgcaggtctggattattataatcataatgtggataccagcgaacgtttttatagcgaaattattaccacccgtacctttgaagatcgcctggaaaccctggccaatgttcgtgatgcaggtattaaagtttgtgcaggcggtattctgggtatgggtgaaaccgtggaagatcgtattagcatgctggttaccctggcaaatctgccggttccgccggaaagcgttccgattaatatgctgattccgattccgggtagcaaactggcaaatgcagatccggttgatccgattgattttgttcgtaccattgcactggcacgtattctgatgccgcgtagccatgttcgtctgagcgcaggtcgtaccgaaatgagcgatgaaacccaggcactgtgttttctggccggtgcaaatagcatttttattggtgaaaccctgctgaccgcagataatccgggtgaagatcatgataccgcactgtttcgtcgtctgggtctgaaaccgatggaactgcagagcagcgaagccggtggttgtcgttaa

SEQ ID NO: 39 - protein, 339 aa, Agrobacterium fabrum
MDQLATQIDGKPASIPAVETSSSLEEAKIIYNLPFNDLLFRAQQVHRCHFDANAIQMSRLLSIKTGGCPEDCSYCSQSARNPTGLKASKLMEVERVLAEARKAKEGGATRYCMGAAWRNPKERDMEAVVAMVEGVKALDMETCMTLGMLTPEQSERLADAGLDYYNHNVDTSERFYSEIITTRTFEDRLETLANVRDAGIKVCAGGILGMGETVEDRISMLVTLANLPVPPESVPINMLIPIPGSKLANADPVDPIDFVRTIALARILMPRSHVRLSAGRTEMSDETQALCFLAGANSIFIGETLLTADNPGEDHDTALFRRLGLKPMELQSSEAGGCR

SEQ ID NO: 40 - DNA, 954 bp, Wolbachia sp.
  CDS (1)..(954): bioB gene encoding biotin synthase from Wolbachia endosymbiont of Cimex lectularius
atgaccgaagaatggacctttgccaaagcagatcagatttttaattttccgtttccggaactgatttatattgcacagaccgaacatcgcaaacagtttaatccgagcgaagtgcagattagcaccctgctgagcattaaaaccggtagctgtccggaaaattgtagctattgtccgcagagcgcacattataataccggtctgcagaaaaaaccgctgctggaaattgcagaagttattgaagcagcaaaatgtgcaaaagaagcaggtagcacccgtttttgtatgggtgcagcatggcgtggtccgcgtgatcaggatctgaaagttgtttgtgaaatgattcgtgaagttaaaaaactgggtctggaaacctgtgttaccctgggtctgctgaaagatcatcaggccaacatgctgaaagaagccggtctggatttttataaccataacatcgataccagcgaagaatattataacaaagtgatcaccacccgtacctttcaggatcgtctggaaaccctggaatgtgttcgtgcaagcggtattaaagtttgttgtggtggtattctgggtatgggtgaaaccaatgaagatcgtattaaaatgctggttctgctggcaaatctgaatgatccgccggaaagcgttccgattaataccctgattaaaattccgggtaccccgctggaaaatgttgcagatgttgatccgtttgattttgttcgtaccattgcaattgcccgtattattatgccgaaaagctatattcgtctgagcgcaggtcgtgaaaaaatgagcgatgaactgcaggcactgtgttttctggccggtgcaaatagcattttttatggtgaaaaactgctgaccgcacagaatccgattccggaacaggataatcatctgtttcagcgtctgggcctgcagaaactggcactgctgcgtgaaaattaa

SEQ ID NO: 41 - protein, 317 aa, Wolbachia sp.
MTEEWTFAKADQIFNFPFPELIYIAQTEHRKQFNPSEVQISTLLSIKTGSCPENCSYCPQSAHYNTGLQKKPLLEIAEVIEAAKCAKEAGSTRFCMGAAWRGPRDQDLKVVCEMIREVKKLGLETCVTLGLLKDHQANMLKEAGLDFYNHNIDTSEEYYNKVITTRTFQDRLETLECVRASGIKVCCGGILGMGETNEDRIKMLVLLANLNDPPESVPINTLIKIPGTPLENVADVDPFDFVRTIAIARIIMPKSYIRLSAGREKMSDELQALCFLAGANSIFYGEKLLTAQNPIPEQDNHLFQRLGLQKLALLREN

SEQ ID NO: 42 - DNA, 1026 bp, Sphingomonas paucimobilis
  CDS (1)..(1026): bioB gene encoding biotin synthase from Sphingomonas paucimobilis NBRC 13935
atgaccaccaccccggcactgagcagtgaagcaaccccgcgtaccgattggacccgtgcagaaattgcagcactgtttgatctgccgtttaccgaactgctgtttcgtgccgcagaagttcatcgtgcacatcatgcagcagatcaggttcagctgagcaccctgctgagcattaaaaccggtggttgtccggaagattgtggttattgtagccagagcacccatgcagataccggtctgaaagcaaccaaactgatggatccgcgtgcagttctgcaggcagcagcacaggcaaaagatcatggtagcacccgtttttgtatgggtgcagcatggcgtaatccgaaagatcgtgatatgccggcaattgttgaaatggtgaaaggtgttcgtgcaatgggtatggaaacctgtatgaccctgggtatgctgaccgatgcacaggcacagaccctggcagaagcaggtctggattattataatcataatattgataccagcccggaacgttatggtgatgtgattaccacccgtagctttggtgaacgtctggaaaccctggaacatgttcgtgatgcaggtattaatgtttgttgtggtggtattgttggtatgggtgaaacccgtggtgatcgtgttggttttattcatgcactggcaaccctgccggttcatccgggtagtgtgccggttaatgcactggttccggttaaaggtaccgttctgggtgatatgctggcagataccccgctggcaaaaattgatgatattgaatttgttcgtaccgttgcagttgcacgtattaccatgccgcatagcatggttcgtctgagcgcaggtcgtgaaagcatgagcgatgcaacccaggcactgtgttttctggccggtgcaaatagcatttttaccggtgataaactgctgaccgcaggtaatgcaggcgatgataaagatgcagccctgtttgcacgtctgggtctgaccccgatggcagcagaatgtaaagttgaactggaagcagcagaataa

SEQ ID NO: 43 - protein, 341 aa, Sphingomonas paucimobilis
MTTTPALSSEATPRTDWTRAEIAALFDLPFTELLFRAAEVHRAHHAADQVQLSTLLSIKTGGCPEDCGYCSQSTHADTGLKATKLMDPRAVLQAAAQAKDHGSTRFCMGAAWRNPKDRDMPAIVEMVKGVRAMGMETCMTLGMLTDAQAQTLAEAGLDYYNHNIDTSPERYGDVITTRSFGERLETLEHVRDAGINVCCGGIVGMGETRGDRVGFIHALATLPVHPGSVPVNALVPVKGTVLGDMLADTPLAKIDDIEFVRTVAVARITMPHSMVRLSAGRESMSDATQALCFLAGANSIFTGDKLLTAGNAGDDKDAALFARLGLTPMAAECKVELEAAE

SEQ ID NO: 44 - DNA, 951 bp, Acidithiobacillus ferrivorans
  CDS (1)..(951): bioB gene encoding biotin synthase from Acidithiobacillus ferrivorans SS3
atgaataccaccgcaccgccgcagaccctggatgcaattctggaaatttatgccagcccgtttaatgatctgatttttgaagcacagaaagtgcatcgcctgcattttgatccgaatgccattcagtgtagcaccctgctgagcattaaaaccggtggttgtccggaagattgtggttattgtagccagagcgcacatcatcagaccgcactgaaagcagaagcactgatggatctggaacaggttcgtgcagcagcacaggaagcaaaagcaaatggtgcacagcgtctgtgtatgggtgcagcatggcgtagcccgcatgataaagatattgaaaaagttgcagcaatgattggtgttgttaaagaatatggtctggaaagctgtgttaccctgggtatgctgaaaccgggtcaggcagaacgtctgcagaatgcgggtctggattattataatcataatctggataccagcccggaattttatggtgaagttattcatacccgtagctatcaggatcgtctggataccctggaaaccgttcgtagcgcaggtattaaaatttgtagcggtggcattctgggtatgggtgaaagccgtcgtgatcgtgcacgtatgctgcagattctggcacatctgccgcaggcaccggaaagcattccgattaatgcactggttccggttccgggtaccccgctggaagcagcagaaccgattgatggttttgaatttgttcgtaccattgcagttgcacgtattctgtttccgaaagcatatgttcgtctgagcgcaggtcgtggtgcaatgagcgatgaactgcaggcactggcatttctggccggtgcaaatagcatttttctgggtgatcgtctgctgaccaccgataatgcaagcatgggtcatgatcagagcctgtttagccgtctgggtctgcatcgtagcgaagcataa

SEQ ID NO: 45 - protein, 316 aa, Acidithiobacillus ferrivorans
MNTTAPPQTLDAILEIYASPFNDLIFEAQKVHRLHFDPNAIQCSTLLSIKTGGCPEDCGYCSQSAHHQTALKAEALMDLEQVRAAAQEAKANGAQRLCMGAAWRSPHDKDIEKVAAMIGVVKEYGLESCVTLGMLKPGQAERLQNAGLDYYNHNLDTSPEFYGEVIHTRSYQDRLDTLETVRSAGIKICSGGILGMGESRRDRARMLQILAHLPQAPESIPINALVPVPGTPLEAAEPIDGFEFVRTIAVARILFPKAYVRLSAGRGAMSDELQALAFLAGANSIFLGDRLLTTDNASMGHDQSLFSRLGLHRSEA

SEQ ID NO: 46 - DNA, 996 bp, Gallionella capsiferriformans
  CDS (1)..(996): bioB gene encoding biotin synthase from Gallionella capsiferriformans ES-2
atgaatacccagaccattgcctttcatcatccggttaaacgtaccgcaaccccggaacgttggagcgttgaagcagttgaaagcctgtttgcactgccgtttgccgatctgctgtatcgtgcacagcaggttcatcgtgaacattttgatccgaatcaggttcagctgagcaccctgctgagcattaaaaccggtggttgtagcgaagattgtggttattgtccgcagagcgcatttcatagcaccggtgttgaagatcgtaaaatgctggcactggatgcagttattgaagcagcaaaagcagcacaggcagcaggcgcagatcgtttttgtatgggtgcagcatggcgtgaaccgagcgaagcagatatgctgagcgttgttgatatggttcaggcagttcgtggcctgggtatggaaacctgtgcaaccctgggtatgctgaatgatgcacagaccgaacagctgcgtgcagccggtctggattattataatcataatctggataccagcccggaattttatggcgatattattagcacccgtgattatcaggatcgcctggataccctggaacgcgttcgtcgtgcaggtatgcatgtttgtagcggtggtattgttggtatgggtgaaagtctgaccgaacgtgcaggtctggttgcccagctggcaaatctgaatccgtatccggaaagcgttccgattaataatctggttaaagttgaaggtaccccgctggcagatgcagcagaactggatccgctggattttgttcgtaccattgcagttgcacgtattaccatgccgaccgcacgtgttcgtctgagcgcaggtcgtcaggcaatgagcgatgcaattcaggcactgtgttttctggccggtgcaaatagcattttttatggtgaacagctgctgaccaccggtaatccggaagttgaacgtgatcgtgcactgatggataaactgggtatgtatccgtttgcagataaacattaa

SEQ ID NO: 47 - protein, 331 aa, Gallionella capsiferriformans
MNTQTIAFHHPVKRTATPERWSVEAVESLFALPFADLLYRAQQVHREHFDPNQVQLSTLLSIKTGGCSEDCGYCPQSAFHSTGVEDRKMLALDAVIEAAKAAQAAGADRFCMGAAWREPSEADMLSVVDMVQAVRGLGMETCATLGMLNDAQTEQLRAAGLDYYNHNLDTSPEFYGDIISTRDYQDRLDTLERVRRAGMHVCSGGIVGMGESLTERAGLVAQLANLNPYPESVPINNLVKVEGTPLADAAELDPLDFVRTIAVARITMPTARVRLSAGRQAMSDAIQALCFLAGANSIFYGEQLLTTGNPEVERDRALMDKLGMYPFADKH

SEQ ID NO: 48 - DNA, 1029 bp, Ralstonia eutropha
  CDS (1)..(1029): bioB gene encoding biotin synthase from Ralstonia eutropha JMP134
atgaatcaggcagcacagaccgttgcaaccattagcgcagaagccctgcgtcagaccgcacgtaatacccatgcactgccggaagatgcacgttggcgtgttgatgatgttgcagcactgtttgccctgccgtttaatgatctgctgtttcgtgcacagcaggttcatcgtgaaaattttgatgcaaataccgttcagctgagcaccctgctgagcattaaaaccggtggttgtgaagaagattgtggttattgtccgcagagcgcacatcatgatgcgggtgttaaagccgaaaaactgatggaactggatgaagttctggaagcagcacgtgcagcaaaagcaaatggtgcaacccgtttttgtatgggtgcagcatggcgtagcccgaaagatcgtcatctggaaccggttatggatatggttcgtgaagttaaagcaatgggtctggaaacctgtgttaccctgggtatgctgaaagcagaacaggcccagcagctgaaagatgccggtctggattattataatcataatctggataccagcccggaattttatggcaaaattattaccacccgtacctatcaggatcgcctggataccattggccatgttcgtgatgcaggtattaatgtttgttgtggtggtattgttggtatgggtgaaagccgtgaagcccgtgcaggtctgattgcacagctggcaaatatggatccgtatccggaaagcgttccgattaataatctggttcaggttgaaggtaccccgctggcaggtaccgaagcactggatccgtttgaatttgttcgtaccattgcagttgcacgtattaccatgccgggtgcaatggttcgtctgagcgcaggtcgtgaagcaatggatgaagcactgcaggcactgtgttttatggccggtgcaaatagcattttttatggtgaaaaactgctgaccaccggtaatccgcaggcagatcgtgatcgtgcactgctggcacgtctggatattcgtgcagaaggttatgcaggttaa

SEQ ID NO: 49 - protein, 342 aa, Ralstonia eutropha
MNQAAQTVATISAEALRQTARNTHALPEDARWRVDDVAALFALPFNDLLFRAQQVHRENFDANTVQLSTLLSIKTGGCEEDCGYCPQSAHHDAGVKAEKLMELDEVLEAARAAKANGATRFCMGAAWRSPKDRHLEPVMDMVREVKAMGLETCVTLGMLKAEQAQQLKDAGLDYYNHNLDTSPEFYGKIITTRTYQDRLDTIGHVRDAGINVCCGGIVGMGESREARAGLIAQLANMDPYPESVPINNLVQVEGTPLAGTEALDPFEFVRTIAVARITMPGAMVRLSAGREAMDEALQALCFMAGANSIFYGEKLLTTGNPQADRDRALLARLDIRAEGYAG

SEQ ID NO: 50 - DNA, 1008 bp, Bordetella parapertussis
  CDS (1)..(1008): bioB gene encoding biotin synthase from Bordetella parapertussis 12822
atgcataccgcatatattccggttccgacaccggttcgtccgccgagtgcagaacgttggccgctggcagcagttgcagaactgtttgaactgccgtttctggatctgctgcatcgtgcacagcaggttcatcgtcagcattttgatgcaaataccgttcagctgagcagcctgctgagcattaaaaccggtggttgtccggaagattgtgcatattgtccgcagagcgcacattatgataccggtgttgatgcagataaactgatgccgctggatgaagttgttcgtgcagcccgtgcagcacaggcaaatggtgcacagcgtttttgtatgggtgcagcatggcgtagcccgaaaccgcatcatctggaagcagtggcagaaatgattggtgcagttaaagcactgggtatggaaacctgtgttaccctgggtatgctgcgtgatggtcaggcagaacagctgaaagcagcaggcctggattattataatcataatctggataccgcaccggaattttatggtaaaattattagcacccgtacctatcaggatcgtctggataccctgcagcaggttcgtgaagcaggtattaatgtttgttgtggtggtattgttggtatgggtgaaagccgtcgtgatcgtgcaggtctggttgcacagctggcaaatatggaaccgtatccggaaagcgttccgattaataatctggttcaggtggaaggtaccccgctggcgggtgcagaaaccctggatccgtttgaatttattcgtaccattgcagttgcacgtattaccatgccgctggccaaagttcgtctgagcgcaggtcgtgaaaccatgagcgatagcgaacaggcactgtgttttatggccggtgcaaatagcattttttatggtgatgttctgctgacaaccggtaatccgcaggttgaagcagatcgtcgtctgctgcagcgtctgggtatgcgtgcagaaggtctgccgtgtgcagccggtcaggcataa

SEQ ID NO: 51 - protein, 335 aa, Bordetella parapertussis
MHTAYIPVPTPVRPPSAERWPLAAVAELFELPFLDLLHRAQQVHRQHFDANTVQLSSLLSIKTGGCPEDCAYCPQSAHYDTGVDADKLMPLDEVVRAARAAQANGAQRFCMGAAWRSPKPHHLEAVAEMIGAVKALGMETCVTLGMLRDGQAEQLKAAGLDYYNHNLDTAPEFYGKIISTRTYQDRLDTLQQVREAGINVCCGGIVGMGESRRDRAGLVAQLANMEPYPESVPINNLVQVEGTPLAGAETLDPFEFIRTIAVARITMPLAKVRLSAGRETMSDSEQALCFMAGANSIFYGDVLLTTGNPQVEADRRLLQRLGMRAEGLPCAAGQA

SEQ ID NO: 52 - DNA, 1044 bp, Pusillimonas sp. T7-7
  CDS (1)..(1044): bioB gene encoding biotin synthase from Pusillimonas sp. T7-7
atggcagcaatgaaaccggcaattccgagccataccccgaccccggatcatgcaccgcaggcatggggtattgcacagattctgcgtctgtatgaactgccgtttctggatctgctgcatcaggcacaggccgttcatcgtgcacatcatcagccgaataccgttcagctgagcagcctgctgagcattaaaaccggtgcatgtccggaagattgtgcatattgtccgcagagcgcacgtcatgataccggtggtaaacaggaagcactgatgccggttgcagaagttctggaagcagcacgtaaagcaaaagcaaatggtgcacagcgtttttgtatgggtgcagcatggcgtagcccgaccgcacgtcagctggatagcgttgttgaaatggttggtgcagttaaagcactgggtctggaaacctgtgttaccctgggtatgctgaaagaaggtcaggcagaacgtctgcgtgatgcgggtctggattattataatcataatctggataccagcccggaattttatggtaatattattaccacccgtagctatcaggatcgtctggataccctggaacgtgttcgtaatgccggtgttcatgtttgttgtggtggtattgttggtctgggtgaaagccgtaaagaacgtgcaggtctggttgcacagctggcaaatctgagcccgtatccggaaagcgttccggttaataatctggttaaagttgcaggtaccccgctggatgccaccccggatattgatccgtttgaatttgttcgtaccattgcagttgcacgtattaccatgccgcgtgcagttgttcgtctgagcgcaggtcgtgaagcaatgagcgatgcaattcaggcactgtgttttatggccggtgcaaatagcattttttatggtgaacagctgctgacaacagcaaatccgcagctgagtcaggatcagcaactgtttcagcgtctgggtctgacagcaaccccggcagatccggcacgtccggcacatctggaacatcatcatgaagcaaccctggcataa

SEQ ID NO: 53 - protein, 347 aa, Pusillimonas sp. T7-7
MAAMKPAIPSHTPTPDHAPQAWGIAQILRLYELPFLDLLHQAQAVHRAHHQPNTVQLSSLLSIKTGACPEDCAYCPQSARHDTGGKQEALMPVAEVLEAARKAKANGAQRFCMGAAWRSPTARQLDSVVEMVGAVKALGLETCVTLGMLKEGQAERLRDAGLDYYNHNLDTSPEFYGNIITTRSYQDRLDTLERVRNAGVHVCCGGIVGLGESRKERAGLVAQLANLSPYPESVPVNNLVKVAGTPLDATPDIDPFEFVRTIAVARITMPRAVVRLSAGREAMSDAIQALCFMAGANSIFYGEQLLTTANPQLSQDQQLFQRLGLTATPADPARPAHLEHHHEATLA

SEQ ID NO: 54 - DNA, 957 bp, Cenarchaeum symbiosum A
  CDS (1)..(957): bioB gene encoding biotin synthase from Cenarchaeum symbiosum A
atgggtattgcagaatgtcgtgataaagttctgggtggtggtgaactgaccaaagatgaagcacgtggtctgatggaagcagatgttaccgaactggccgcagcagcagatgaaattacccgtcgttttaatggtgatggtgtggatgtggaacagctgaataatattaaacgtgatggttgcagcgaagattgtaccttttgtggtcagagcgccttttatgatgcagataaagaaccgcatccgctgccggaaccggaagaagttgttcgtgcagccctgaaagcaaaaaaagaagaagccagcagctattgtctggttgccgcatggcgtgaaccgaccccggaaggttttgaaaaagtttgtaccattattcaggaaattaatacccatgttggtattagcgttgaatgtagcctgggttttctgacccgtgaacgtgcagcacgtctgaaaggtctgggtgttaaacgttataatcataatctggaaaccgcccgtagcaaatttccggaaatttgtagcacccatacctatgaagatcgtctggataccctggaaattgcacgtgaagccggtctggaactgtgtaccggtggtattattggtatgggtgaaagccgtggtcagcgtattgaactggcaatggaactggcacgtattcgtccggaagaagcaaccgttaatattctggttccggttcagggtaccccgatggaactgcaggcaccgctgccgccgggtgaagcagaacgtttttttgcactggttcgttttctgctgccgcgtagcgttgttaaaattagcggtggtcgtgaaaaagcactggatgatgatggtcgtgcaattctgcgtggtggtgcaaatggtattattaccagcggttatctgacaatgggtggtaatgatagcagcgcagatatggaaatgattcgtgaagcaggtctggaagcataa

SEQ ID NO: 55 - protein, 318 aa, Cenarchaeum symbiosum A
MGIAECRDKVLGGGELTKDEARGLMEADVTELAAAADEITRRFNGDGVDVEQLNNIKRDGCSEDCTFCGQSAFYDADKEPHPLPEPEEVVRAALKAKKEEASSYCLVAAWREPTPEGFEKVCTIIQEINTHVGISVECSLGFLTRERAARLKGLGVKRYNHNLETARSKFPEICSTHTYEDRLDTLEIAREAGLELCTGGIIGMGESRGQRIELAMELARIRPEEATVNILVPVQGTPMELQAPLPPGEAERFFALVRFLLPRSVVKISGGREKALDDDGRAILRGGANGIITSGYLTMGGNDSSADMEMIREAGLEA

SEQ ID NO: 56 - DNA, 999 bp, Alicyclobacillus acidocaldarius subsp. acidocaldarius DSM 446
  CDS (1)..(999): bioB gene encoding biotin synthase from Alicyclobacillus acidocaldarius subsp. acidocaldarius DSM 446
atgatgaaaattgattatcagaccaattggattgatctggcccgtcgtgttctggatggtcgtggtgttacccgtgaagaagcactggatattctgcgttctagcgatgatgaactgctggatctgctggcagcagcctttctgattcgtcgccgctattttggcaaaaaagtgaaactgaatatgattattaatgccaaaagcaaaatgtgcccggaagattgcgcctattgcagccagagcgccattagcaaagcaccggttagcaaatatccgctggttagtaaagaagaaattattgccggtgcacgtgaagcagaacgtcgtaaagcaggtacctattgtattgttattagcggtcgtcgtccgagcgatcgtgaaattgaacgtattgcagaagcagttgaagaaattcgtgcaaccaccaccctgaaaatttgttgttgtctgggtctgctgaccccggcacaggcagatcgtctggcacgtgcgggtgttcatcgttataatcataatctgaataccagccgtgatcgttatggtgatatttgtaccacccatacctatgatgatcgcgttcgtaccctggaacatgtgaaagaagcaggtattagcccgtgtagcggtgttatttttggtatgggtgaaagcgatgaagaagccgttgatatggcctttgccctgaaagaaatggatgcagatagcattccgtgtaattttctgaatccgattccgggtaccccgctggaaggtatggaaaccctgaatccgcgtcgttgtctgaaactgctgtgtatgatgcgttttgttaatccgagcaaagaaattcgtattgcgggtggtcgtgaacgtaatctgcgtagcctgcaggttctgggtctgtatccggcaaatagcatttttgttggtgattatctgaccaccccgggtcaggcaccgaccgaagattgggcaatgattgaagatctgggttttgaaattgaagaatgtgcactgtaa

SEQ ID NO: 57 - protein, 332 aa, Alicyclobacillus acidocaldarius subsp. acidocaldarius DSM 446
MMKIDYQTNWIDLARRVLDGRGVTREEALDILRSSDDELLDLLAAAFLIRRRYFGKKVKLNMIINAKSKMCPEDCAYCSQSAISKAPVSKYPLVSKEEIIAGAREAERRKAGTYCIVISGRRPSDREIERIAEAVEEIRATTTLKICCCLGLLTPAQADRLARAGVHRYNHNLNTSRDRYGDICTTHTYDDRVRTLEHVKEAGISPCSGVIFGMGESDEEAVDMAFALKEMDADSIPCNFLNPIPGTPLEGMETLNPRRCLKLLCMMRFVNPSKEIRIAGGRERNLRSLQVLGLYPANSIFVGDYLTTPGQAPTEDWAMIEDLGFEIEECAL

SEQ ID NO: 58 - DNA, 996 bp, Geobacillus thermoglucosidasius C56-YS93
  CDS (1)..(996): bioB gene encoding biotin synthase from Geobacillus thermoglucosidasius C56-YS93
atgattaattggctggccctggcagatcgtgttattgcaggtcatgaactgaccgatgaagaagcactggcaattctggattgtccggatgaagaactgctgctgctgatgcagggtgcctataatattcgtcgcacctattatggcaataaagttaaactgaatatgattattaatgccaaaagcggtctgtgcccggaaaattgcggctattgcgcacagagcgcagttagcaccgcaccggttaaaacctataaaatggttgataaagaaaccctgattcgtggtgcagaagaagcatatcgtatgcgtattggtacctattgtattgttgcaagcggtcgtggtccgagcgaaaaagaaattgataccgttgtgagcgccgttaaagaaattaaagaacgttttggtctgaaaatttgtgcatgtctgggtattctgaaaccggaacaggcagcacgtctgaaagaagccggtgttgatcgctataatcataatattaataccagcaaagaacatcatccgaatattaccaccagccatacctatgatgatcgcgtgcgtaccgttgaaaccgttaaacaggcaggtattagcccgtgtagcggtgttattattggtatgcgtgaaaccaaacaggatgttattaatatggcacgtagtctgcgcattctggatgcagatagcattccggttaattttctgcatgcaattgatggtaccccgctggcaggtaccaatgaactggatccgcgttattgtctgaaagttctggcactgtttcgttatatgaatccgaccaaagaaattcgtattgccggtggtcgtgaagttaatctgcgtagcctgcagccgctgggtctgtatgcagcaaatagcatttttgttggtgattatctgaccaccgcaggtcaggaaaaaagcgaagattatcgcatgctggaagatctgggttttgaaattgattttgccgaagaacagcaggttgtttgttaa

SEQ ID NO: 59 - protein, 331 aa, Geobacillus thermoglucosidasius C56-YS93
MINWLALADRVIAGHELTDEEALAILDCPDEELLLLMQGAYNIRRTYYGNKVKLNMIINAKSGLCPENCGYCAQSAVSTAPVKTYKMVDKETLIRGAEEAYRMRIGTYCIVASGRGPSEKEIDTVVSAVKEIKERFGLKICACLGILKPEQAARLKEAGVDRYNHNINTSKEHHPNITTSHTYDDRVRTVETVKQAGISPCSGVIIGMRETKQDVINMARSLRILDADSIPVNFLHAIDGTPLAGTNELDPRYCLKVLALFRYMNPTKEIRIAGGREVNLRSLQPLGLYAANSIFVGDYLTTAGQEKSEDYRMLEDLGFEIDFAEEQQVVC

SEQ ID NO: 60 - DNA, 1008 bp, Bacillus subtilis subsp. subtilis str. 168
  CDS (1)..(1008): bioB gene encoding biotin synthase from Bacillus subtilis subsp. subtilis str. 168
atgaatcagtggatggaactggcagatcgtgttctggccggtgcagaagttaccgatgaagaagcactgagcattctgcattgcccggatgaagatatcctgctgctgatgcatggtgcctttcatattcgcaaacatttttatggcaaaaaagtgaaactgaatatgattatgaacgccaaaagcggtctgtgtccggaaaattgcggttattgcagccagagcgcaattagcaaagcaccgattgaaagctatcgtatggttaataaagaaaccctgctggaaggtgcaaaacgtgcacatgatctgaatattggtacctattgtattgttgcaagcggtcgtggtccgagcaatcgcgaagttgatcaggttgttgatgcagttcaggaaattaaagaaacctatggtctgaaaatttgtgcatgtctgggtctgctgaaaccggaacaggcaaaacgtctgaaagatgcaggcgttgatcgttataatcataatctgaataccagccagcgtaaccatagcaatattaccaccagccatacctatgatgatcgtgtgaataccgttgaaattgccaaagaaagtggtctgagcccgtgtagcggtgcaattattggtatgaaagaaaccaaacaggatgttattgatattgcgaaaagcctgaaagcactggatgcagatagcattccggtgaattttctgcatgcaattgatggtaccccgctggaaggtgttaatgaactgaatccgctgtattgtctgaaagttctggcactgtttcgttttattaatccgagcaaagaaattcgtattagcggtggtcgtgaagttaatctgcgtaccctgcagccgctgggtctgtatgcagcaaatagcatttttgttggtgattatctgaccaccgcaggtcaggaagaaaccgaagatcataaaatgctgagcgatctgggttttgaagttgaaagcgttgaagaaatgaaagcaagcctgagcgcaaaaagctaa

SEQ ID NO: 61 - protein, 335 aa, Bacillus subtilis subsp. subtilis str. 168
MNQWMELADRVLAGAEVTDEEALSILHCPDEDILLLMHGAFHIRKHFYGKKVKLNMIMNAKSGLCPENCGYCSQSAISKAPIESYRMVNKETLLEGAKRAHDLNIGTYCIVASGRGPSNREVDQVVDAVQEIKETYGLKICACLGLLKPEQAKRLKDAGVDRYNHNLNTSQRNHSNITTSHTYDDRVNTVEIAKESGLSPCSGAIIGMKETKQDVIDIAKSLKALDADSIPVNFLHAIDGTPLEGVNELNPLYCLKVLALFRFINPSKEIRISGGREVNLRTLQPLGLYAANSIFVGDYLTTAGQEETEDHKMLSDLGFEVESVEEMKASLSAKS

SEQ ID NO: 62 - DNA, 996 bp, Lysinibacillus sphaericus
  CDS (1)..(996): bioB gene encoding biotin synthase from Lysinibacillus sphaericus
atgaattttctgcaggttgcccaggaagttattgatggcaaaattattagcaatgaagaagccctggccattctgaatagcaaagatgatgaactgctgcagctgatggatggtgcatttgccattcgccgccattattatggtaaaaaagtgaaactgaacatgattatgaacgccaaaagcggttattgcccggaagattgtggttattgtagccagagcagcaaaagcaccgcaccgattgaaaaatatccgtttattaccaaagaagaaattctggccggtgccaaacgtgcctttgataataaaattggtacctattgcattgttgccagcggtcgtggtccgacccgtaaagatgttaatgttgtgagcgaagcagttaccgaaattaaagaaaaatatggcctgaaagtttgtgcatgtctgggtctgctgaaagaagaacaggcacagcagctgaaagaagccggtgttgatcgctataatcataatctgaacaccagcgaacgtcatcatagctttattaccaccagccatacctatgaagatcgtgtgaacaccgtggaaattgtgaaaaaacatggtattagcccgtgtagcggtgcaattattggtatgaaagaaacccgtgaagatgttgttaatattgcacgtgcactgcatcagctggatgcagatagcattccggttaattttctgaatgcaattgatggtaccaaactggaaggtacccgtgatctgaatccgcgttattgtctgaaagtgctggcactgtttcgttatattaatccgaccaaagaaattcgtattagcggtggtcgtgaaattaatctgggtagcctgcagccgctgggtctgtatgcagcaaatagcatttttgttggtgattatctgaccaccgcaggtcaggaagccaatagcgattatcgtatgctggaagatctgggttttgaaattgaactgacccagaaacaggaagcagcattttgttaa

SEQ ID NO: 63 - protein, 331 aa, Lysinibacillus sphaericus
MNFLQVAQEVIDGKIISNEEALAILNSKDDELLQLMDGAFAIRRHYYGKKVKLNMIMNAKSGYCPEDCGYCSQSSKSTAPIEKYPFITKEEILAGAKRAFDNKIGTYCIVASGRGPTRKDVNVVSEAVTEIKEKYGLKVCACLGLLKEEQAQQLKEAGVDRYNHNLNTSERHHSFITTSHTYEDRVNTVEIVKKHGISPCSGAIIGMKETREDVVNIARALHQLDADSIPVNFLNAIDGTKLEGTRDLNPRYCLKVLALFRYINPTKEIRISGGREINLGSLQPLGLYAANSIFVGDYLTTAGQEANSDYRMLEDLGFEIELTQKQEAAFC

SEQ ID NO: 64 - DNA, 1002 bp, Methylococcus capsulatus str. Bath
  CDS (1)..(1002): bioB gene encoding biotin synthase from Methylococcus capsulatus str. Bath
atgcatgcagaagttgcagttatgaccaatcaggaacgtgcagaagaaccggttctgcgtcatgattggacccagggtgaagcagaagcactgtttgcactgccgtttaatgaactgctgtttcaggcacagaccattcatcgtcgtcattttgatccgaatgaagttcaggttagcagcctgctgagcattaaaaccggtgcatgtagcgaagattgtgcatattgtccgcagagcgcacattatgaaaccggtgttaaacgtgaaagcctgatgagcctggaagatgttctggaagcagcacagcgtgcacgtgaagaaggtgcaacccgtttttgtatgggtgcagcatggcgtagcccgcgtgatggtgatctggaagcaattgcagcaatggttgaaggtgttaaagcactgggtatggaaacctgtgttaccgccggtatgctgagtgatgaacaggcccgtcgtctgaaagaagccggtctggattattataatcataatctggataccagcgaaagctattatggcgaaattattaccacccgcacctatcaggatcgtctggataccctgcagcgtgttcgtgatgcaggtatgcatgtttgttgtggtggtattgttggtatgggtgaaagcgcagcagatcgtgcaggtctgctgattggtctggcaaatctgccgcgtcatccggaaagcgttccgattaatctgctggttcgtgttgaaggtaccccgctggcagataccgcagcactggatccgtttgattttgttcgtaccgttgcagttgcacgtattatgatgccggcaagccgtgttcgtctgagcgcaggtcgtagcgatatgagcgatgaaatgcaggcactgtgttttctggccggtgcaaatagcattttttatggtgatcgtctgctgaccaccgaaaatccgcaggcccagcgtgatcgccgtctgtttgcccgtctgggtctgcgtatggcaggtctgggttgttaa

SEQ ID NO: 65 - protein, 333 aa, Methylococcus capsulatus str. Bath
MHAEVAVMTNQERAEEPVLRHDWTQGEAEALFALPFNELLFQAQTIHRRHFDPNEVQVSSLLSIKTGACSEDCAYCPQSAHYETGVKRESLMSLEDVLEAAQRAREEGATRFCMGAAWRSPRDGDLEAIAAMVEGVKALGMETCVTAGMLSDEQARRLKEAGLDYYNHNLDTSESYYGEIITTRTYQDRLDTLQRVRDAGMHVCCGGIVGMGESAADRAGLLIGLANLPRHPESVPINLLVRVEGTPLADTAALDPFDFVRTVAVARIMMPASRVRLSAGRSDMSDEMQALCFLAGANSIFYGDRLLTTENPQAQRDRRLFARLGLRMAGLGC

SEQ ID NO: 66 - DNA, 1041 bp, Leclercia adecarboxylata
  CDS (1)..(1041): bioB gene encoding biotin synthase from Leclercia adecarboxylata
atggcacatcagacccgttggaccctgagccaggttaccgcactgtttgaaaaaccgctgctggaactgctgtttgaagcacagcagattcatcgtcagcattttgatccgcagcagattcaggttagcaccctgctgagcattaaaaccggtgcatgtccggaagattgtaaatattgtccgcagagcgcacgttataaaaccggtctggaatcagaacgtctgatggaagttgaacaggttctggaaagcgcacgtcaggcaaaaaatgcaggtagcacccgtttttgtatgggtgcagcatggaaaaatccgcatgaacgtgatatgccgtatctggaacagatggttcagggtgttaaagcaatgggtctggaagcatgtatgaccctgggtaccctggatgatacccaggcacagcgtctggcaagcgcaggtctggattattataatcataatctggataccagcccggaattttatggcaatattattaccacccgcacctatcaggaacgcctggataccctggataaagttcgtgatgcaggtattaaagtttgtagcggtggtattgttggtctgggtgaaaccgttaccgatcgtgcaggtctgctgctgcagctggcaaatctgccgaccccgccggaaagcgttccgattaatatgctggttaaagttaaaggtaccccgctggccgataatgatgatgttgatgcatttgattttattcgtaccattgcagtggcccgtgtgatgatgccgaccagctttgttcgtctgagcgccggtcgtgaacagatgaatgaacagacccaggccatgtgttttatggccggtgcaaatagcattttttatggttgtaaactgctgaccaccccgaatccggaagaagataaagatgttcagctgtttcgtaaactgggtctgaatccgcagcagaccgcagttctgaccggtgataatgaacagcagcatcagctggaacagcagctgattaatgcagataccgatcagttttataatgcagcaaccgtttaa

SEQ ID NO: 67 - protein, 346 aa, Leclercia adecarboxylata
MAHQTRWTLSQVTALFEKPLLELLFEAQQIHRQHFDPQQIQVSTLLSIKTGACPEDCKYCPQSARYKTGLESERLMEVEQVLESARQAKNAGSTRFCMGAAWKNPHERDMPYLEQMVQGVKAMGLEACMTLGTLDDTQAQRLASAGLDYYNHNLDTSPEFYGNIITTRTYQERLDTLDKVRDAGIKVCSGGIVGLGETVTDRAGLLLQLANLPTPPESVPINMLVKVKGTPLADNDDVDAFDFIRTIAVARVMMPTSFVRLSAGREQMNEQTQAMCFMAGANSIFYGCKLLTTPNPEEDKDVQLFRKLGLNPQQTAVLTGDNEQQHQLEQQLINADTDQFYNAATV

SEQ ID NO: 68 - DNA, 1113 bp, Chromohalobacter salexigens DSM 3043
  CDS (1)..(1113): bioB gene encoding biotin synthase from Chromohalobacter salexigens DSM 3043
atgaccgcacagagccgtgatccggcatggaccgatgcaagcccgacctttcagccgaccatgcgtcatgattggagcctggaagaaattgaagcactgtttgcactgccgtttaatgatctgctgtttcgtgcacagcaggttcatcgtgcacattttgatccgaatgcagttcaggttagcaccctgctgagcattaaaaccggtgcatgtccggaagattgtaaatattgtccgcagagcggtcattataataccggcctgggtaaagaaaaactgctggaaattgaaaaagttgttgaacaggcccgtgcagcaaaagcagcaggcgcaagccgtttttgtatgggtgcagcatggcgtagcccgcgtgaaaaagatctgcgtgttgttaccgaaatggttggtcgtgttaaagcactgggcctggaaacctgtatgaccctgggtatggttgatgttgatcaggcacgtcgtctggcagaagccggtctggattattataatcataatctggataccagcccggattattatggtgaaattattaccacccgtacctatgcagatcgtctggaaaccctggccaatgttcgtgaagcaggtatgaaagtttgtagtggtggtattctgggtatgggtgaagcaccgcgtgatcgcgcagcactgctgcagcagctggttcgtctggatccgcatccggaaagcgttccgattaatatgctggttaaagttccgggtaccccgatggaaaatgttgaagatatggatccgctgacctttattcgtgcaattgcagttgcacgtattctgatgccgaaaagccatgttcgtctgagcgcaggtcgtgaacagatggatgaaagcacccaggcactggcatttctggccggtgcaaatagcattttttatggtgataccctgctgaccaccggtaatccgcaggttgaacgtgatcgtgccctgtttgataaactgggtctgcatccggaaccgagcgatccgcatgcagatgatgcccatcgtgatgatgaacaggcagaaattgcactggcacatgcaattcagcgtcagcgtgatgatgcactgttttatgatgcaacccgtggttaa

SEQ ID NO: 69 - protein, 370 aa, Chromohalobacter salexigens DSM 3043
MTAQSRDPAWTDASPTFQPTMRHDWSLEEIEALFALPFNDLLFRAQQVHRAHFDPNAVQVSTLLSIKTGACPEDCKYCPQSGHYNTGLGKEKLLEIEKVVEQARAAKAAGASRFCMGAAWRSPREKDLRVVTEMVGRVKALGLETCMTLGMVDVDQARRLAEAGLDYYNHNLDTSPDYYGEIITTRTYADRLETLANVREAGMKVCSGGILGMGEAPRDRAALLQQLVRLDPHPESVPINMLVKVPGTPMENVEDMDPLTFIRAIAVARILMPKSHVRLSAGREQMDESTQALAFLAGANSIFYGDTLLTTGNPQVERDRALFDKLGLHPEPSDPHADDAHRDDEQAEIALAHAIQRQRDDALFYDATRG

SEQ ID NO: 70 - DNA, 1059 bp, Pseudomonas caeni
  CDS (1)..(1059): bioB gene encoding biotin synthase from Pseudomonas caeni
atgaccaccagcccgcatgcagatacccgtcatgattggaccctggcagaagttaccgcactgctgcagcagccgtttaatgatctgatttttcaggcacagagcgttcatcgtcagcattttaatgcaaatcgtgttcaggttagcaccctgctgagcattaaaaccggtgcatgtccggaagattgtaaatattgtccgcagagcggtcattataataccggtctggataaagaaaaactgatggaagtgcagaaagttctggatgaagccaaacgtgccaaagaaattggtagcacccgtttttgcatgggtgcagcatggaaacatccgagcgcaaaagatctgccgtatgttctggaaatggttaaaggtgttaaagcaatgggtatggaaacctgtatgaccctgggtaaactggatgaagcacagaccaaagcgctggcagatgcgggtctggattattataatcataatctggataccagcccggaattttatggtaatattattaccacccgtacctatgcagaacgtctgcagaccctgagctatgttcgtgatgcaggtatgaaaatttgtagcggtggtattctgggtatgggtgaaagcattgcagatcgtgcaggtctgctgattcagctggcaaatctgccggaacatccggaaagcgttccgattaatatgctggttaaagttgaaggtaccccgctggaaaatgcagaagatgttgatccgtttgattttattcgtatgctggcagttgcacgcattatgatgccgaaaagccatgttcgtctgagcgcaggtcgtgaacagatgaatgaacagatgcagagcctggcatttctggccggtgcaaatagcattttttatggtgaaaaactgctgaccaccgcaaatccgcaggcagataaagatatgcagctgtttgcacgtctgggtattaaaccggaagcacgtgaagaatatgcagatgaagttcatcaggcagcaattgaacatgcaattattgaacagcgtgatgccagcctgttttatgatgcagcaacccattaa

SEQ ID NO: 71 - protein, 352 aa, Pseudomonas caeni
MTTSPHADTRHDWTLAEVTALLQQPFNDLIFQAQSVHRQHFNANRVQVSTLLSIKTGACPEDCKYCPQSGHYNTGLDKEKLMEVQKVLDEAKRAKEIGSTRFCMGAAWKHPSAKDLPYVLEMVKGVKAMGMETCMTLGKLDEAQTKALADAGLDYYNHNLDTSPEFYGNIITTRTYAERLQTLSYVRDAGMKICSGGILGMGESIADRAGLLIQLANLPEHPESVPINMLVKVEGTPLENAEDVDPFDFIRMLAVARIMMPKSHVRLSAGREQMNEQMQSLAFLAGANSIFYGEKLLTTANPQADKDMQLFARLGIKPEAREEYADEVHQAAIEHAIIEQRDASLFYDAATH

SEQ ID NO: 72 - DNA, 1059 bp, Pseudomonas monteilii
  CDS (1)..(1059): bioB gene encoding biotin synthase from Pseudomonas monteilii
atgagcgcaagcaccattgcaaccacccgtcatgattggaccctggccgaagttcgtgcactgtttcagcagccgtttaatgatctgctgtttcaggcacagagcgttcatcgtgcacattttgatgcaaatcgtgttcaggttagcaccctgctgagcattaaaaccggtgcatgtccggaagattgtaaatattgcccgcagagcggtcattataataccggtctggaaaaacagaaactgatggaagttcagaaagttctggaagaagcagcacgtgccaaagcaattggtagcacccgtttttgcatgggtgcagcatggaaacatccgagcgcaaaagatatgccgtatgttctgcagatggttcagggtgttaaagcaatgggtctggaaacctgtatgaccctgggtcgtctggatcgcgaacagaccgcagcactggcagaagcaggtctggattattataatcataatctggataccagcccggaattttatggtagcattattaccacccgtacctatgcagaacgtctgcagaccctggcatatgttcgtgatgcaggtatgaaaatttgtagcggtggtattctgggtatgggtgaaagcctggatgatcgtgcaaatctgctgattcagctggccaatctgccggaacatccggaaagcgttccgattaatatgctggttaaagttgccggtaccccgctggcaaatgaagaagatgttgatccgtttgattttattcgtatgctggcagttgcacgtattctgatgccgcagagccatgttcgtctgagcgcaggtcgtgaacagatgaatgaacagatgcaggcactggcatttctggccggtgcaaatagcattttttatggtgaaaaactgctgaccaccggtaatccgcaggcagatcgtgatatgcagctgtttgcacgtctgggtattcagccggaagccggtgaaggtcatgcagatgaagttcatcaggcagcaattgaacaggcagttattgaacagcgtaatggtgaactgttttatgatgcagttagcgcataa

SEQ ID NO: 73 - protein, 352 aa, Pseudomonas monteilii
MSASTIATTRHDWTLAEVRALFQQPFNDLLFQAQSVHRAHFDANRVQVSTLLSIKTGACPEDCKYCPQSGHYNTGLEKQKLMEVQKVLEEAARAKAIGSTRFCMGAAWKHPSAKDMPYVLQMVQGVKAMGLETCMTLGRLDREQTAALAEAGLDYYNHNLDTSPEFYGSIITTRTYAERLQTLAYVRDAGMKICSGGILGMGESLDDRANLLIQLANLPEHPESVPINMLVKVAGTPLANEEDVDPFDFIRMLAVARILMPQSHVRLSAGREQMNEQMQALAFLAGANSIFYGEKLLTTGNPQADRDMQLFARLGIQPEAGEGHADEVHQAAIEQAVIEQRNGELFYDAVSA

SEQ ID NO: 74 - DNA, 1059 bp, Pseudomonas massiliensis CB1
  CDS (1)..(1059): bioB gene encoding biotin synthase from Pseudomonas massiliensis CB1
atgagcgcaagcctgaatagcccgctgcgtcatgattggaccctgagcgaagttaaagccctgtttacccagccgtttaatgatctgctgtttcatgcaatgagcgttcatcgtgcacattttgatccgaatcaggttcaggttagcaccctgctgagcattaaaaccggtgcatgtccggaagattgtaaatattgtccgcagagcggtcattataataccggcctggaaaaagaaaaactgctggaagtgcagaaagtgattgaagaagcagcacgtgccaaagcaattggtagcacccgtttttgtatgggtgcagcatggaaacatccgagcgcaaaagatatgccgtatgttctggaaatggttcgtggtgttaaagcactgggtctggaaacctgtatgaccctgggtcgtctggatcgtgatcagaccgttgcactggcagaagcaggtctggattattataatcataatctggataccagcccggaattttatggcaatattattaccacccgtacctatggtgaacgtctgcagaccctggcctatgttcgtgatgcaggtatgaaaatttgtagcggtggtattctgggtatgggtgaaagcctggatgatcgtgcaggtctgctgattcagctggcaaatctgccggaacatccggaaagcgttccgattaatatgctggttaaagttgccggtaccccgctggaaaatgcagaagatgttgatccgtttgattttattcgtatgctggcagttgcacgtattctgatgccgcgtagccatgttcgtctgagcgcaggtcgtgaacagatgaatgaacagatgcaggccctggcatttatggccggtgcaaatagcattttttatggtgaaaaactgctgaccaccgcaaatccgcaggcagataaagatatgcgtctgtttgcacgtctgggtattcgtccggaagcacgtgaagaacatgatgatgaagttcatcaggcagcaattgaacaggcactggttgaacagcgtagcggtgaactgttttatgatgcagcagcagtttaa

SEQ ID NO: 75 - protein, 352 aa, Pseudomonas massiliensis CB1
MSASLNSPLRHDWTLSEVKALFTQPFNDLLFHAMSVHRAHFDPNQVQVSTLLSIKTGACPEDCKYCPQSGHYNTGLEKEKLLEVQKVIEEAARAKAIGSTRFCMGAAWKHPSAKDMPYVLEMVRGVKALGLETCMTLGRLDRDQTVALAEAGLDYYNHNLDTSPEFYGNIITTRTYGERLQTLAYVRDAGMKICSGGILGMGESLDDRAGLLIQLANLPEHPESVPINMLVKVAGTPLENAEDVDPFDFIRMLAVARILMPRSHVRLSAGREQMNEQMQALAFMAGANSIFYGEKLLTTANPQADKDMRLFARLGIRPEAREEHDDEVHQAAIEQALVEQRSGELFYDAAAV

SEQ ID NO: 76 - DNA, 1059 bp, Pseudomonas putida F1
  CDS (1)..(1059): bioB gene encoding biotin synthase from Pseudomonas putida F1
atgagcgcaagcaccaccgcaaccacccgtcatgattggagcctggcagaagttaaagccctgtttcagcagccgtttaatgatctgctgtttcaggcacagaccgttcatcgtgcacattttaatccgaatcgtgttcaggttagcaccctgctgagcattaaaaccggtgcatgcccggaagattgtaaatattgtccgcagagcggtcattataataccggtctggaaaaacagaaactgatggaagttcagaaagttctggaagaagcagcccgtgcaaaagcaattggtagcacccgtttttgcatgggtgcagcatggaaacatccgagcgcaaaagatatgccgtatgttctggaaatggttaaaggtgttaaagcaatgggcctggaaacctgtatgaccctgggtaaactggatcaggaacagaccaaagcactggcacatgcgggtctggattattataatcataatctggataccagcccggaattttatggcagcattattaccacccgtacctatagcgaacgtctgcagaccctggcatatgttcgtgatgcaggtatgaaaatttgtagcggtggtattctgggtatgggtgaaagcctggatgatcgtgcaggtctgctgattcagctggcaaatctgccggaacatccggaaagcgttccgattaatatgctggttaaagttgcaggtaccccgctggccgaagaagaagatgttgatccgtttgattttattcgtatgctggcagttgcacgtattctgatgccgaaaagccatgttcgtctgagcgcaggtcgtgaacagatgaatgaacagatgcaggcgctggcatttatggccggtgcaaatagcattttttatggtgaaaaactgctgaccaccgccaatccgcaggcagataaagatatgcagctgtttgcacgtctgggtattaaaccggaagcacgtgaagaacatgcagatgaagttcatcaggcagcaattgaacaggcactggttgaacagcgtagcagcgaaatgttttatgatgcagcaaccgcataa

SEQ ID NO: 77 - protein, 352 aa, Pseudomonas putida F1
MSASTTATTRHDWSLAEVKALFQQPFNDLLFQAQTVHRAHFNPNRVQVSTLLSIKTGACPEDCKYCPQSGHYNTGLEKQKLMEVQKVLEEAARAKAIGSTRFCMGAAWKHPSAKDMPYVLEMVKGVKAMGLETCMTLGKLDQEQTKALAHAGLDYYNHNLDTSPEFYGSIITTRTYSERLQTLAYVRDAGMKICSGGILGMGESLDDRAGLLIQLANLPEHPESVPINMLVKVAGTPLAEEEDVDPFDFIRMLAVARILMPKSHVRLSAGREQMNEQMQALAFMAGANSIFYGEKLLTTANPQADKDMQLFARLGIKPEAREEHADEVHQAAIEQALVEQRSSEMFYDAATA

SEQ ID NO: 78 - DNA, 1059 bp, Pseudomonas thermotolerans
  CDS (1)..(1059): bioB gene encoding biotin synthase from Pseudomonas thermotolerans
atgaatgcaagcgttgcagcagcaattcgtcatgattggaccctggcagaagttaaagccctgtttgcactgccgtttaatgatctgctgtatcaggcacagaccgttcatcgtcagtattttgatgcaaatcgtgttcaggttagcaccctgctgagcattaaaaccggtgcatgtccggaagattgtaaatattgtccgcagagcggtcattataataccggcctggaaaaacagaaactgatggaagttcagaaagttctgcaggcagcagcagaagcaaaagcaatgggtagcacccgtttttgtatgggtgcagcatggaaacatccgagcgcaaaagattttccgtatgttctggaaatggttaaaggtgttaaagcactgggtctggaaacctgtatgaccctgggtcgtctgtcacgtgaacagacccaggcactggcggaagccggtctggattattataatcataatctggataccagcccggaattttatggtcgtattattaccacccgtacctatgcagaacgtctgcagaccctggcatatgttcgtgaagcaggtatgaaaatttgtagcggtggtattctgggtatgggtgaaagcctggatgatcgtgcaggtctgctgattcagctggcaaatctgccggaacatccggaaagcgttccgattaatatgctggttaaagttcagggtaccccgctggcagatgcagaagatgttgatccgtttgattttattcgtaccctggcggttgcacgtattatgatgccgaaaagccatgttcgtctgagcgcaggtcgcgaacagatgaatgaacagatgcaggcgctggcatttctggccggtgcaaatagcattttttatggtgaaaaactgctgaccaccggtaatccgcaggcagaaaaagatctgcagctgtttcgtcgtctgggtattcagccggaagaacgtgaagaacatgcagatgaagttcatcaggccgcaattgaacaggccctggccgaacagcgtgatagccagctgttttatgatgcagcaagcgcataa

SEQ ID NO: 79 - protein, 352 aa, Pseudomonas thermotolerans
MNASVAAAIRHDWTLAEVKALFALPFNDLLYQAQTVHRQYFDANRVQVSTLLSIKTGACPEDCKYCPQSGHYNTGLEKQKLMEVQKVLQAAAEAKAMGSTRFCMGAAWKHPSAKDFPYVLEMVKGVKALGLETCMTLGRLSREQTQALAEAGLDYYNHNLDTSPEFYGRIITTRTYAERLQTLAYVREAGMKICSGGILGMGESLDDRAGLLIQLANLPEHPESVPINMLVKVQGTPLADAEDVDPFDFIRTLAVARIMMPKSHVRLSAGREQMNEQMQALAFLAGANSIFYGEKLLTTGNPQAEKDLQLFRRLGIQPEEREEHADEVHQAAIEQALAEQRDSQLFYDAASA

SEQ ID NO: 80 - DNA, 1059 bp, pseudomonad ancestor
  CDS (1)..(1059): bioB gene encoding biotin synthase from pseudomonad ancestor
atgagcgcaagcaccaatagcccgctgcgtcatgattggaccctgagcgaagttaaagcactgtttacccagccgtttaatgatctgctgtttcatgcaatgaccgttcatcgtgcacattttgatccgaatcaggttcaggttagcaccctgctgagcattaaaaccggtgcatgtccggaagattgtaaatattgtccgcagagcggccattataataccggcctggaaaaagaaaaactgatggaagtgcagaaagttattgaagaagcagcacgtgccaaagcaattggtagcacccgtttttgcatgggtgcagcatggaaacatccgagcgcaaaagatatgccgtatgttctggaaatggttcgtggtgttaaagcaatgggtctggaaacctgtatgaccctgggtcgtctggatcaggatcagaccgttgcactggcagaagcaggtctggattattataatcataatctggataccagcccggaattttatggtaatattattaccacccgtacctatggtgaacgtctgcagaccctggcctatgttcgtgatgcaggtatgaaaatttgtagcggtggtattctgggtatgggtgaaagcctggatgatcgtgcaggtctgctgattcagctggcaaatctgccggaacatccggaaagcgttccgattaatatgctggttaaagttgcaggtaccccgctggaaaatgcagaagatgttgatccgtttgattttattcgtatgctggcagttgcacgtattctgatgccgcgtagccatgttcgtctgagcgcaggtcgtgaacagatgaatgaacagatgcaggccctggcatttatggccggtgcaaatagcattttttatggtgaaaaactgctgaccaccgcaaatccgcaggcagataaagatatgcagctgtttgcacgtctgggtattcgtccggaagcacgtgaagaacatgatgatgaagttcatcaggcagcaattgaacaggcactggttgaacagcgtagcagcgaaatgttttatgatgcagcagcagtttaa

SEQ ID NO: 81 - protein, 352 aa, pseudomonad ancestor
MSASTNSPLRHDWTLSEVKALFTQPFNDLLFHAMTVHRAHFDPNQVQVSTLLSIKTGACPEDCKYCPQSGHYNTGLEKEKLMEVQKVIEEAARAKAIGSTRFCMGAAWKHPSAKDMPYVLEMVRGVKAMGLETCMTLGRLDQDQTVALAEAGLDYYNHNLDTSPEFYGNIITTRTYGERLQTLAYVRDAGMKICSGGILGMGESLDDRAGLLIQLANLPEHPESVPINMLVKVAGTPLENAEDVDPFDFIRMLAVARILMPRSHVRLSAGREQMNEQMQALAFMAGANSIFYGEKLLTTANPQADKDMQLFARLGIRPEAREEHDDEVHQAAIEQALVEQRSSEMFYDAAAV

SEQ ID NO: 82 - DNA, 1059 bp, Pseudomonas aeruginosa PAO1
  CDS (1)..(1059): bioB gene encoding biotin synthase from Pseudomonas aeruginosa PAO1
atgagcgcaaccgcaagcgttgcaacccgtcatgattggagcctggcagaagttcgtgcactgtttgaacagccgtttaatgatctgctgtttcaggcacagaccgttcatcgtgcacattttgatccgaatcgtgttcaggttagcaccctgctgagcattaaaaccggtgcatgtccggaagattgtaaatattgtccgcagagcggtcattataataccggcctggataaagaaaaactgatggaagttcagaaagttctggaagcagcagcagaagcaaaagcaattggtagcacccgtttttgcatgggtgcagcatggaaacatccgagcgcaaaagatatgccgtatgttctggaaatggttaaaggtgttaaaaaactgggtctggaaacctgtatgaccctgggtcgtctgacccaggaacagacccaggcgctggcagatgccggtctggattattataatcataatctggataccagcccggaattttatggtaatattattaccacccgtacctatagcgaacgtctgcagaccctggcctatgttcgtgaagcaggtatgaaaatttgtagcggtggtattctgggtatgggtgaaagcgttgatgatcgtgcaggtctgctgattcagctggcaaatctgccggaacatccggaaagcgttccgattaatatgctggttaaagttaaaggtaccccgctggccgaagaaaaagatgttgatccgtttgattttattcgtaccctggcagttgcccgtattatgatgccgaaaagccatgttcgtctgagcgcaggtcgtgaacagatgaatgaacagatgcaggcactggcatttatggccggtgcaaatagcattttttatggtgaaaaactgctgaccaccaaaaatccgcaggccgaaaaagatatgcagctgtttgcacgtctgggtattaaaccggaagaacgtgaagaacatgcagatgaagttcatcaggcagcaattgaacaggccctggttgaacagcgtgaaagcaaactgttttataatgcagcaagcgcataa

SEQ ID NO: 83 - protein, 352 aa, Pseudomonas aeruginosa PAO1
MSATASVATRHDWSLAEVRALFEQPFNDLLFQAQTVHRAHFDPNRVQVSTLLSIKTGACPEDCKYCPQSGHYNTGLDKEKLMEVQKVLEAAAEAKAIGSTRFCMGAAWKHPSAKDMPYVLEMVKGVKKLGLETCMTLGRLTQEQTQALADAGLDYYNHNLDTSPEFYGNIITTRTYSERLQTLAYVREAGMKICSGGILGMGESVDDRAGLLIQLANLPEHPESVPINMLVKVKGTPLAEEKDVDPFDFIRTLAVARIMMPKSHVRLSAGREQMNEQMQALAFMAGANSIFYGEKLLTTKNPQAEKDMQLFARLGIKPEEREEHADEVHQAAIEQALVEQRESKLFYNAASA

SEQ ID NO: 84 - DNA, 1059 bp, Pseudomonas balearica
  CDS (1)..(1059): bioB gene encoding biotin synthase from Pseudomonas balearica
atgagcgcaaccgcaagcattgcaacccgtcatgattggagcctggcggaagttaaagcactgtttgaacagccgtttaatgatctgctgtttcaggcacagaccgttcatcgtgcacattttgatccgaatcgtgttcaggttagcaccctgctgagcattaaaaccggtgcatgtccggaagattgcaaatattgtccgcagagcggtcattataataccggtctggataaagaaaaactgatggaagttcagaaagttctggaagcagcagcagaagccaaagcaattggtagcacccgtttttgcatgggtgcagcatggaaacatccgagcgcaaaagatatgccgtatgttctggaaatggttaaaggtgttaaaaaactgggtctggaaacctgtatgaccctgggtcgtctggatcaggaacagacccaggccctggcagaagcaggcctggattattataatcataatctggataccagcccggaattttatggtaatattattaccacccgtacctatagcgaacgcctgcagaccctggcatatgttcgtgaagcaggtatgaaaatttgtagcggtggtattctgggtatgggtgaaagcgttgatgatcgtgcaggtctgctgattcagctggcaaatctgccggaacatccggaaagcgttccgattaatatgctggttaaagtgaaaggtaccccgctggccgaagaaaaagatgttgatccgtttgattttattcgtaccctggccgttgcacgtattatgatgccgaaaagccatgttcgtctgagcgcaggtcgtgaacagatgaatgaacagatgcaggcgctggcatttatggccggtgcaaatagcattttttatggtgaaaaactgctgaccaccgcaaatccgcaggcagaaaaagatatgcagctgtttgcacgtctgggtattaaaccggaagaacgtgaagaacatgcagatgaagttcatcaggcagcaattgaacaggcactggttgaacagcgtgatagccagctgttttatgatgcagcaagcgcataa

SEQ ID NO: 85 - protein, 352 aa, Pseudomonas balearica
MSATASIATRHDWSLAEVKALFEQPFNDLLFQAQTVHRAHFDPNRVQVSTLLSIKTGACPEDCKYCPQSGHYNTGLDKEKLMEVQKVLEAAAEAKAIGSTRFCMGAAWKHPSAKDMPYVLEMVKGVKKLGLETCMTLGRLDQEQTQALAEAGLDYYNHNLDTSPEFYGNIITTRTYSERLQTLAYVREAGMKICSGGILGMGESVDDRAGLLIQLANLPEHPESVPINMLVKVKGTPLAEEKDVDPFDFIRTLAVARIMMPKSHVRLSAGREQMNEQMQALAFMAGANSIFYGEKLLTTANPQAEKDMQLFARLGIKPEEREEHADEVHQAAIEQALVEQRDSQLFYDAASA

SEQ ID NO: 86 - DNA, 1056 bp, Pseudomonas fluorescens SBW25
  CDS (1)..(1056): bioB gene encoding biotin synthase from Pseudomonas fluorescens SBW25
atgagcgcaagcaccaccgccaccctgcgtcatgattggagcctggcagaagttaaagcactgtttgttcagccgtttaatgatctgctgtttcaggcacagaccgttcatcgtgcacattttgatgcaaatcgtgttcaggttagcaccctgctgagcattaaaaccggtgcatgtccggaagattgtaaatattgtccgcagagcggtcattataataccggcctggaaaaagaaaaactgatggaagttcagaaagttctggaagaagcagcacgtgcaaaagcaattggtagcacccgtttttgcatgggtgcagcatggaaacatccgagcgcaaaagatatgccgtatgttctgcagatggttaaaggtgttaaagcaatgggtctggaaacctgtatgaccctgggtcgtctggatcaggatcagaccgaagcactggcacaggcaggtctggattattataatcataatctggataccagcccggaattttatggtagcattattaccacccgtacctatggtgaacgtctgcagaccctggcatatgttcgtgatagcggtatgaaaatttgtagcggtggtattctgggtatgggtgaaagcctggatgatcgtgcaaatctgctgattcagctggccaatctgccggaacatccggaaagcgttccgattaatatgctggttaaagttgcaggtaccccgctggaaaatgccgaagatattgatccgtttgattttattcgtatgctggcagttgcacgtattctgatgccgcgtagccatgttcgtctgagcgcaggtcgtgaagcaatgaatgaacagatgcaggcactggccttttttgccggtgcaaatagcattttttatggtgataaactgctgaccaccgcaaatccgcaggcagataaagatatgcagctgtttagccgtctgggtattctgccggaagcacgtgaagaacatgcagatgaagttcatcaggcagcaattgaacaggccctggttgaacagaaaagcagcgaacagttttataatgcagcagtttaa

SEQ ID NO: 87 - protein, 351 aa, Pseudomonas fluorescens SBW25
MSASTTATLRHDWSLAEVKALFVQPFNDLLFQAQTVHRAHFDANRVQVSTLLSIKTGACPEDCKYCPQSGHYNTGLEKEKLMEVQKVLEEAARAKAIGSTRFCMGAAWKHPSAKDMPYVLQMVKGVKAMGLETCMTLGRLDQDQTEALAQAGLDYYNHNLDTSPEFYGSIITTRTYGERLQTLAYVRDSGMKICSGGILGMGESLDDRANLLIQLANLPEHPESVPINMLVKVAGTPLENAEDIDPFDFIRMLAVARILMPRSHVRLSAGREAMNEQMQALAFFAGANSIFYGDKLLTTANPQADKDMQLFSRLGILPEAREEHADEVHQAAIEQALVEQKSSEQFYNAAV

SEQ ID NO: 88 - DNA, 756 bp, Escherichia coli
  CDS (1)..(756): bioC gene encoding SAM (S-adenosylmethionine)-dependent methyltransferase (BioC)
atggcaacggttaataaacaagccattgcagcggcatttggtcgggcagccgcacactatgagcaacatgcagatctacagcgccagagtgctgacgccttactggcaatgcttccacagcgtaaatacacccacgtactggacgcgggttgtggacctggctggatgagccgccactggcgggaacgtcacgcgcaggtgacggccttagatctctcgccgccaatgcttgttcaggcacgccagaaggatgccgcagaccattatctggcgggagatatcgaatccctgccgttagcgactgcgacgttcgatcttgcatggagcaatctcgcagtgcagtggtgcggtaatttatccacggcactccgcgagctgtatcgggtggtgcgccccaaaggcgtggtcgcgtttaccacgctggtgcagggatcgttacccgaactgcatcaggcgtggcaggcggtggacgagcgtccgcatgctaatcgctttttaccgccagatgaaatcgaacagtcgctgaacggcgtgcattatcaacatcatattcagcccatcacgctgtggtttgatgatgcgctcagtgccatgcgttcgctgaaaggcatcggtgccacgcatcttcatgaagggcgcgacccgcgaatattaacgcgttcgcagttgcagcgattgcaactggcctggccgcaacagcaggggcgatatcctctgacgtatcatctttttttgggagtgattgctcgtgagtaa

SEQ ID NO: 89 - protein, 251 aa, Escherichia coli [sequence omitted]

SEQ ID NO: 90 - DNA, 1155 bp, Escherichia coli
  CDS (1)..(1155): bioF gene encoding (Bio F) 7-keto-8-aminopelargonic acid (KAPA) synthase
atgagctggcaggagaaaatcaacgcggcgctcgatgcgcggcgtgctgccgatgccctgcgtcgccgttatccggtggcgcaaggagccggacgctggctggtggcggatgatcgccagtatctgaacttttccagtaacgattatttaggtttaagccatcatccgcaaattatccgtgcctggcagcagggggcggagcaatttggcatcggtagcggcggctccggtcacgtcagcggttatagcgtggtgcatcaggcactggaagaagagctggccgagtggcttggctattcgcgggcactgctgtttatctctggtttcgccgctaatcaggcagttattgccgcgatgatggcgaaagaggaccgtattgctgccgaccggcttagccatgcctcattgctggaagctgccagtttaagcccgtcgcagcttcgccgttttgctcataacgatgtcactcatttggcgcgattgcttgcttccccctgtccggggcagcaaatggtggtgacagaaggcgtgttcagcatggacggcgatagtgcgccactggcggaaatccagcaggtaacgcaacagcacaatggctggttgatggtcgatgatgcccacggcacgggcgttatcggggagcaggggcgcggcagctgctggctgcaaaaggtaaaaccagaattgctggtagtgacttttggcaaaggatttggcgtcagcggggcagcggtgctttgctccagtacggtggcggattatctgctgcaattcgcccgccaccttatctacagcaccagtatgccgcccgctcaggcgcaggcattacgtgcgtcgctggcggtcattcgcagtgatgagggtgatgcacggcgcgaaaaactggcggcactcattacgcgttttcgtgccggagtacaggatttgccgtttacgcttgctgattcatgcagcgccatccagccattgattgtcggtgataacagccgtgcgttacaactggcagaaaaactgcgtcagcaaggctgctgggtcacggcgattcgcccgccaaccgtacccgctggtactgcgcgactgcgcttaacgctaaccgctgcgcatgaaatgcaggatatcgaccgtctgctggaggtgctgcatggcaacggttaa

SEQ ID NO: 91 - protein, 384 aa, Escherichia coli [sequence omitted]

SEQ ID NO: 92 - DNA, 1290 bp, Escherichia coli
  CDS (1)..(1290): bioA gene encoding 7,8-Diaminopelargonic Acid (DAPA) Synthase (BioA)
atgacaacggacgatcttgcctttgaccaacgccatatctggcacccatacacatccatgacctcccctctgccggtttatccggtggtgagcgccgaaggttgcgagctgattttgtctgacggcagacgcctggttgacggtatgtcgtcctggtgggcggcgatccacggctacaatcacccgcagcttaatgcggcgatgaagtcgcaaattgatgccatgtcgcatgtgatgtttggcggtatcacccatgcgccagccattgagctgtgccgcaaactggtggcgatgacgccgcaaccgctggagtgcgtttttctcgcggactccggttccgtagcggtggaagtggcgatgaaaatggcgttgcagtactggcaagccaaaggcgaagcgcgccagcgttttctgaccttccgcaatggttatcatggcgatacctttggcgcgatgtcggtgtgcgatccggataactcaatgcacagtctgtggaaaggctacctgccagaaaacctgtttgctcccgccccgcaaagccgcatggatggcgaatgggatgagcgcgatatggtgggctttgcccgcctgatggcggcgcatcgtcatgaaatcgcggcggtgatcattgagccgattgtccagggcgcaggcgggatgcgcatgtaccatccggaatggttaaaacgaatccgcaaaatatgcgatcgcgaaggtatcttgctgattgccgacgagatcgccactggatttggtcgtaccgggaaactgtttgcctgtgaacatgcagaaatcgcgccggacattttgtgcctcggtaaagccttaaccggcggcacaatgaccctttccgccacactcaccacgcgcgaggttgcagaaaccatcagtaacggtgaagccggttgctttatgcatgggccaacttttatgggcaatccgctggcctgcgcggcagcaaacgccagcctggcgattctcgaatctggcgactggcagcaacaggtggcggatattgaagtacagctgcgcgagcaacttgcccccgcccgtgatgccgaaatggttgccgatgtgcgcgtactgggggccattggcgtggtcgaaaccactcatccggtgaatatggcggcgctgcaaaaattctttgtcgaacagggtgtctggatccggccttttggcaaactgatttacctgatgccgccctatattattctcccgcaacagttgcagcgtctgaccgcagcggttaaccgcgcggtacaggatgaaacatttttttgccaataa

SEQ ID NO: 93 - protein, 429 aa, Escherichia coli
MTTDDLAFDQRHIWHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 94 - DNA, 678 bp, Escherichia coli
  CDS (1)..(678): bioD gene encoding Dethiobiotin (DTB) Synthetase (BioD)
gtgagtaaacgttattttgtcaccggaacggataccgaagtggggaaaactgtcgccagttgtgcacttttacaagccgcaaaggcagcaggctaccggacggcaggttataaaccggtcgcctctggcagcgaaaagaccccggaaggtttacgcaatagcgacgcgctggcgttacagcgcaacagcagcctgcagctggattacgcaacagtaaatccttacaccttcgcagaacccacttcgccgcacatcatcagcgcgcaagagggcagaccgatagaatcattggtaatgagcgccggattacgcgcgcttgaacaacaggctgactgggtgttagtggaaggtgctggcggctggtttacgccgctttctgacactttcacttttgcagattgggtaacacaggaacaactgccggtgatactggtagttggtgtgaaactcggctgtattaatcacgcgatgttgactgcacaggtaatacaacacgccggactgactctggcgggttgggtggcgaacgatgttacgcctccgggaaaacgtcacgctgaatatatgaccacgctcacccgcatgattcccgcgccgctgctgggagagatcccctggcttgcagaaaatccagaaaatgcggcaaccggaaagtacataaaccttgccttgttgtag

SEQ ID NO: 95 - protein, 225 aa, Escherichia coli
VSKRYFVTGTDTEVGKTVASCALLQAAKAAGYRTAGYKPVASGSEKTPEGLRNSDALALQRNSSLQLDYATVNPYTFAEPTSPHIISAQEGRPIESLVMSAGLRALEQQADWVLVEGAGGWFTPLSDTFTFADWVTQEQLPVILVVGVKLGCINHAMLTAQVIQHAGLTLAGWVANDVTPPGKRHAEYMTTLTRMIPAPLLGEIPWLAENPENAATGKYINLALL

SEQ ID NO: 96 - DNA, 1347 bp, Bacillus subtilis
  CDS (1)..(1347): bioK gene encoding L-lysine:8-amino-7-oxononanoate aminotransferase (BioK)
atgactcacgatttaatcgaaaaaagcaaaaagcacttgtggctgcccttcactcagatgaaagattatgacgaaaaccctttgatcattgaaagcggcacagggattaaagtaaaagatatcaatgggaaggaatattacgacggcttcagttctgtttggctgaacgttcacgggcaccgcaagaaggagcttgatgacgcaatcaagaagcaattaggtaagattgcgcatagtacgcttttaggaatgacgaatgtccctgcaactcaattagctgaaacacttattgatatttcccctaaaaagctgacccgtgttttttattctgattccggtgcagaagctatggagattgcgcttaaaatggcctttcagtattggaaaaatattggcaaaccagaaaagcaaaaattcatcgccatgaagaatggataccacggtgataccatcggagcagtaagcgtaggctcaattgagttgtttcaccacgtatatggtccattgatgtttgagtcttacaaggcgcctattccctatgtttaccgctcggagtcaggtgacccagatgagtgccgcgaccagtgccttcgcgaattggcccagcttttggaggaacaccatgaggagatcgcggcactgagtattgaatcaatggttcaaggggcgagtggaatgattgtaatgccagaaggctacttagcaggcgtacgcgaactttgcacgacttacgatgtcttgatgattgtggatgaagttgcaacaggattcggtcgcaccgggaaaatgtttgcatgcgaacatgaaaacgtgcaaccggatctgatggccgcaggcaagggtatcacgggcggataccttccgattgcggttacttttgccaccgaagacatttataaggcattttacgatgattatgaaaacttgaagaccttttttcatggacactcttacacaggaaatcaactgggttgtgcagtcgcactggagaatctggcactgtttgaaagcgaaaacattgttgagcaggtcgctgaaaaatcgaagaaattacattttttattacaagatttacatgccttgccacatgtaggcgacatccgtcaattaggattcatgtgtggtgcggagttagtccgtagcaaagaaacaaaagagccctatcccgctgatcgtcgcatcggttacaaagtcagtcttaaaatgcgtgaattagggatgttgacacgcccgttgggagatgttattgcatttttgcctccgttagcgtctaccgcggaggagctgagtgagatggtagcaattatgaagcaagccattcacgaagttacttccttggaagactga

SEQ ID NO: 97 - protein, 448 aa, Bacillus subtilis
MTHDLIEKSKKHLWLPFTQMKDYDENPLIIESGTGIKVKDINGKEYYDGFSSVWLNVHGHRKKELDDAIKKQLGKIAHSTLLGMTNVPATQLAETLIDISPKKLTRVFYSDSGAEAMEIALKMAFQYWKNIGKPEKQKFIAMKNGYHGDTIGAVSVGSIELFHHVYGPLMFESYKAPIPYVYRSESGDPDECRDQCLRELAQLLEEHHEEIAALSIESMVQGASGMIVMPEGYLAGVRELCTTYDVLMIVDEVATGFGRTGKMFACEHENVQPDLMAAGKGITGGYLPIAVTFATEDIYKAFYDDYENLKTFFHGHSYTGNQLGCAVALENLALFESENIVEQVAEKSKKLHFLLQDLHALPHVGDIRQLGFMCGAELVRSKETKEPYPADRRIGYKVSLKMRELGMLTRPLGDVIAFLPPLASTAEELSEMVAIMKQAIHEVTSLED

SEQ ID NO: 98 - DNA, 771 bp, Escherichia coli
  CDS (1)..(771): bioH gene encoding Pimeloyl-[acyl-carrier protein] methyl ester esterase (BioH)
atgaataacatctggtggcagaccaaaggtcaggggaatgttcatcttgtgctgctgcacggatggggactgaatgccgaagtgtggcgttgcattgacgaggaacttagctcgcattttacgctgcaccttgttgacctgcccggcttcgggcgtagccggggatttggtgcgctgtcacttgctgatatggccgaagccgtgctgcaacaggcacctgataaagccatttggttaggctggagtctgggcgggctggtggcaagccagattgcgttaacccatcccgagcgtgttcaggcgctggtcaccgtggcgtcgtcaccttgttttagtgctcgtgacgagtggccggggataaaaccggacgtgctggcgggatttcagcagcaactcagtgatgattttcagcgtacagtggagcggttcctggcgttacaaaccatggggactgaaacggcgcgccaggatgcgcgggcgttgaagaaaaccgttctggcgttaccgatgccggaggttgacgtgcttaatggcgggctggaaatcctgaaaacggtcgatctccgtcagccgctgcaaaacgtgtccatgccgtttttgcgattgtatggctatctcgacggtctggtgccgcgcaaagtggtgccgatgctggataaactttggcctcacagcgaatcatatatcttcgccaaagcggcccatgcgccatttatttcgcatccggccgagttttgtcacctgctggtggcgttgaagcagagggtgtag

SEQ ID NO: 99 - protein, 256 aa, Escherichia coli
MNNIWWQTKGQGNVHLVLLHGWGLNAEVWRCIDEELSSHFTLHLVDLPGFGRSRGFGALSLADMAEAVLQQAPDKAIWLGWSLGGLVASQIALTHPERVQALVTVASSPCFSARDEWPGIKPDVLAGFQQQLSDDFQRTVERFLALQTMGTETARQDARALKKTVLALPMPEVDVLNGGLEILKTVDLRQPLQNVSMPFLRLYGYLDGLVPRKVVPMLDKLWPHSESYIFAKAAHAPFISHPAEFCHLLVALKQRV

SEQ ID NO: 100 - DNA, 777 bp, Bacillus subtilis
  CDS (1)..(777): bioW gene encoding 6-carboxyhexanoate-CoA ligase (BioW)
atgcaagaagagacgttctattcagtgcgtatgcgcgcttcaatgaatggctcccacgaagatggaggtaagcacatctccgggggtgagcgccttatcccgttccacgagatgaaacataccgtcaacgctttgcttgagaagggtctttctcattctcgtgggaaacctgattttatgcaaattcagtttgaagaggttcacgagtcaatcaagacaatccagcccttacctgtgcacaccaacgaagttagctgccccgaagaaggacaaaaacttgcacgcttgttactggagaaagaaggggtgagccgcgacgttattgaaaaggcttacgaacaaattcccgagtggtcggatgtccgtggtgccgtattgtttgatattcatacgggcaagcgtatggatcagacgaaagaaaagggggtgcgcgtctctcgtatggactggcccgacgctaactttgagaaatgggccttacacagccacgtgccagcacattcacgcatcaaggaggcactggcacttgctagcaaggtgtcccgtcacccggcagtcgttgccgaattgtgttggagcgacgatccagattacatcaccggatatgtagctggtaaaaaaatggggtaccaacgcattaccgcaatgaaggagtacgggaccgaggagggatgtcgtgtcttcttcatcgacggctcgaacgatgttaatacttacattcacgacttggagaaacagccgatcctgattgaatgggaagaagaccacgatagctga

SEQ ID NO: 101 - protein, 258 aa, Bacillus subtilis
MQEETFYSVRMRASMNGSHEDGGKHISGGERLIPFHEMKHTVNALLEKGLSHSRGKPDFMQIQFEEVHESIKTIQPLPVHTNEVSCPEEGQKLARLLLEKEGVSRDVIEKAYEQIPEWSDVRGAVLFDIHTGKRMDQTKEKGVRVSRMDWPDANFEKWALHSHVPAHSRIKEALALASKVSRHPAVVAELCWSDDPDYITGYVAGKKMGYQRITAMKEYGTEEGCRVFFIDGSNDVNTYIHDLEKQPILIEWEEDHDS

SEQ ID NO: 102 - DNA, 966 bp, Escherichia coli
  CDS (1)..(966): lipA gene encoding lipoic acid synthase (LipA)
atgagtaaacccattgtgatggaacgcggtgttaaataccgcgatgccgataagatggcccttatcccggttaaaaacgtggcaacagagcgcgaagccctgctgcgcaagccggaatggatgaaaatcaagcttccagcggactctacacgtatccagggcatcaaagccgcaatgcgcaaaaatggcctgcattctgtctgcgaggaagcctcctgccctaacctggcggaatgcttcaaccacggcacagcaacgtttatgatcctcggcgctatttgtacccgccgttgtccgttctgtgatgttgcccacggtcgcccggtagctcctgatgccaatgaaccagtgaaactggcgcagaccattgccgatatggcgctgcgttatgtggttatcacctccgttgaccgtgatgacctgcgcgatggcggtgcccagcactttgcggattgcattactgccattcgggaaaaaagcccgcaaatcaaaattgaaactctggtgccggatttccgcggtcgtatggatcgtgctctggatattctgactgcaacgccaccagatgtgttcaaccataacctggaaaacgtaccgcgtatttaccgtcaggtacggcctggtgcagattacaactggtcgctgaagctgctggaacgctttaaagaagcgcatccggaaatcccgaccaagtctggtctgatggtgggactgggtgaaaccaatgaagaaattattgaggtaatgcgcgacctgcgccgtcatggtgtgacgatgttaacgctggggcaatatttgcagccaagccgccatcacctgccggttcaacgttacgttagcccggatgagttcgacgaaatgaaagccgaagcgctggcgatgggctttacccatgctgcatgcggtccgtttgtccgctcttcttaccacgccgatttgcaggcgaaagggatggaagttaagtaa

SEQ ID NO: 103 - protein, 321 aa, Escherichia coli
MSKPIVMERGVKYRDADKMALIPVKNVATEREALLRKPEWMKIKLPADSTRIQGIKAAMRKNGLHSVCEEASCPNLAECFNHGTATFMILGAICTRRCPFCDVAHGRPVAPDANEPVKLAQTIADMALRYVVITSVDRDDLRDGGAQHFADCITAIREKSPQIKIETLVPDFRGRMDRALDILTATPPDVFNHNLENVPRIYRQVRPGADYNWSLKLLERFKEAHPEIPTKSGLMVGLGETNEEIIEVMRDLRRHGVTMLTLGQYLQPSRHHLPVQRYVSPDEFDEMKAEALAMGFTHAACGPFVRSSYHADLQAKGMEVK

SEQ ID NO: 104 - DNA, 897 bp, Bacillus subtilis subsp. Subtilis, str. 168
  CDS (1)..(897): lipA gene encoding a lipoic acid synthase (LipA)
atggcgaagaaggatgaacacctgagaaagccagaatggcttaaaattaagctgaatacaaacgaaaactacactggcttaaaaaagttaatgcgtgagaataacttacatactgtctgtgaggaggcaaaatgtccaaatatacacgaatgctgggccgttcggcgtaccgcgacgtttatgatactgggctccgtctgcacgagagcatgtcgtttttgcgcggttaaaaccggcctgccgactgagcttgacttgcaagagccagagcgcgtggctgattcagttgcccttatgaacctgaaacacgccgttatcacggcggtcgcccgtgacgatcaaaaagatggtggagcgggaatattcgcagaaacggtacgtgctatccgccggaagtctccatttaccacgattgaagtgctgccgagcgatatgggcggtaattatgataaccttaagaccttgatggacacacggccggatattctgaatcacaacatcgagactgtacggcgtttaacaccaagagtcagagcacgcgctacctatgatcgcagccttgaattcttgcgtcgcgccaaagagatgcagcccgacataccaacaaaaagtagtataatgatcggcttgggagaaacaaaagaagaaatcatcgaggtcatggatgaccttttggcaaacaacgtggacataatggccattgggcaatacttgcaaccaactaaaaagcacttaaaagttcagaaatactatcatcctgatgaatttgccgagttgaaggaaatcgccatgcagaaggggttttcacattgcgaggcgggtccgttggtccgttcaagttaccacgcggacgaacaggtgaatgaagcgtcaaagaaacgccaagcacaagcttaa

SEQ ID NO: 105 - protein, 298 aa, Bacillus subtilis subsp. Subtilis, str. 168
MAKKDEHLRKPEWLKIKLNTNENYTGLKKLMRENNLHTVCEEAKCPNIHECWAVRRTATFMILGSVCTRACRFCAVKTGLPTELDLQEPERVADSVALMNLKHAVITAVARDDQKDGGAGIFAETVRAIRRKSPFTTIEVLPSDMGGNYDNLKTLMDTRPDILNHNIETVRRLTPRVRARATYDRSLEFLRRAKEMQPDIPTKSSIMIGLGETKEEIIEVMDDLLANNVDIMAIGQYLQPTKKHLKVQKYYHPDEFAELKEIAMQKGFSHCEAGPLVRSSYHADEQVNEASKKRQAQA

SEQ ID NO: 106 - DNA, 1245 bp, Saccharomyces cerevisiae, S288C
  CDS (1)..(1245): lipA gene encoding a lipoic acid synthase (LipA)
atgtacagacgtagtgtaggggtgcttttcgtagggcgtaacactcggtggatcagcagcacgatccggtgtggcactagcgcaacccgccctattcgtagtaacgcgttgaacactgactcagataacgctagtgtgcgcgtacccgtagggaacagcacggaggtagaaaatgcgacctcgcaactgacaggtacttcgggcaagagacggaagggaaatagaaagcggataacggaatttaaagatgccttaaacctgggtccctcgttcgccgatttcgtatcaggtaaggcttcgaaaatgattttggatcctttggagaaagcccgccagaacacagaggaggctaagaagttacctagatggttgaaagtgcctattcctaaaggcacgaactaccacaaattgaaaggtgatgtaaaagaattaggactttccactgtctgtgaggaagctcgctgcccaaatatcggagagtgctggggaggaaaggacaaatccaaggctacggcgacgataatgttgcttggcgatacgtgcacgcgcggttgccgtttttgctctgtaaagactaaccgcacaccctcgaaacctgatcctatggagcccgaaaatacagcagaggcgattaaacgttggggcctgggctatgttgtattaactacagtagatcgtgatgatttagtcgacggtggggcaaatcatttggcggagactgtcagaaagatcaagcaaaaagcgccgaatactcttgtggagactctttccggtgactttagaggggacttaaagatggttgacatcatggcacaatgcggcttagatgtttacgctcataacttagaaaccgttgaaagtttaactccccacgtaagagaccggcgggccacatacagacaaagtctgagcgttttggagcgtgccaaagccacggtgccatcattaatcactaaaacctctataatgttaggcttaggggaaacggacgaacaaataacgcaaaccttaaaagatttacggaacattcaatgcgacgtcgtgacctttggtcaatatatgcggccaacaaagcggcacatgaaggtggtcgagtacgtaaaacccgaaaaatttgattactggaaggagcgggctcttgagatgggtttcttatattgcgcctctgggccacttgtacgctctagctataaagcgggtgaggcatttatcgagaatgttttaaaaaaaagaaacatgaagtga

SEQ ID NO: 107 - protein, 414 aa, Saccharomyces cerevisiae, S288C
MYRRSVGVLFVGRNTRWISSTIRCGTSATRPIRSNALNTDSDNASVRVPVGNSTEVENATSQLTGTSGKRRKGNRKRITEFKDALNLGPSFADFVSGKASKMILDPLEKARQNTEEAKKLPRWLKVPIPKGTNYHKLKGDVKELGLSTVCEEARCPNIGECWGGKDKSKATATIMLLGDTCTRGCRFCSVKTNRTPSKPDPMEPENTAEAIKRWGLGYVVLTTVDRDDLVDGGANHLAETVRKIKQKAPNTLVETLSGDFRGDLKMVDIMAQCGLDVYAHNLETVESLTPHVRDRRATYRQSLSVLERAKATVPSLITKTSIMLGLGETDEQITQTLKDLRNIQCDVVTFGQYMRPTKRHMKVVEYVKPEKFDYWKERALEMGFLYCASGPLVRSSYKAGEAFIENVLKKRNMK

SEQ ID NO: 108 - DNA, 1017 bp, Pseudomonas putida KT2440
  CDS (1)..(1017): lipA gene encoding a lipoic acid synthase (LipA)
atgacgaccgttcaggaagccgtcccgaatttgatccccacgcaagatgctacgccgcgcccggctcccaaaaaggttgaagctggtgtgaagttgcgcggagcggataaagttgcccgcatccctgtgaaaattattccgacagatgagttaccgaaaaaacctgactggatccgcgtccgcatccctgtatcgcccgaggttgatcgtatcaaacaattgttgcgtaagcacaaattgcatagcgtctgcgaggaggcctcctgcccaaatttgggcgagtgctttagcggcggcacggctactttcatgattatgggcgacatctgtacacgtcgttgtcctttttgcgacgtgggacacggacgcccaaagccgctggatttggatgagccaaaaaatcttgcagttgcgattgcagacttgcgcttaaagtacgtggttatcacatcggttgatcgtgacgatttacgtgacgggggcgctcaacattttgccgactgcatccgtgagatccgcgcactgtccccgggggtgcagctggagactttggttccggactaccgtggacgcatggatgttgcattggagattaccgcccaggagcctccagatgtgttcaaccataatcttgagacagtcccacgcttatataaggctgctcgtccgggttctgattacgactggagtttagacttgttgcaaaaatttaagcagctggttccgcatgtgccaactaagtctggactgatgttaggattaggagaaacagatgaggaagtcattgaagtaatgcatcgtatgcgtgagcatgatatcgacatgttgactctgggacagtaccttcagccctcgcgttcgcatcttcctgttcagcgttttgttcatcccgatacttttgcttggttcgcggaagagggatacaagatggggttcaaaaatgtcgcttctggaccattggtacgctcgtcatatcacgcagaccagcaggctcatgaggccaaaattaagctttga

SEQ ID NO: 109 - protein, 338 aa, Pseudomonas putida KT2440
MTTVQEAVPNLIPTQDATPRPAPKKVEAGVKLRGADKVARIPVKIIPTDELPKKPDWIRVRIPVSPEVDRIKQLLRKHKLHSVCEEASCPNLGECFSGGTATFMIMGDICTRRCPFCDVGHGRPKPLDLDEPKNLAVAIADLRLKYVVITSVDRDDLRDGGAQHFADCIREIRALSPGVQLETLVPDYRGRMDVALEITAQEPPDVFNHNLETVPRLYKAARPGSDYDWSLDLLQKFKQLVPHVPTKSGLMLGLGETDEEVIEVMHRMREHDIDMLTLGQYLQPSRSHLPVQRFVHPDTFAWFAEEGYKMGFKNVASGPLVRSSYHADQQAHEAKIKL

SEQ ID NO: 110 - DNA, 867 bp, Bacteroides fragilis 638R
  CDS (1)..(867): lipA gene encoding a lipoic acid synthase (LipA)
atggggaacgacaagcgcgttcgcaagcctgagtggttaaaaatttctattggtgcaaatgagcgctacaccgagactaaacgtatcgtggaaagccattgtcttcacaccatctgcagttctgggcgctgcccgaatatgggggaatgttgggggaaagggacagcaacctttatgatcgctggtgacatctgcactcgctcttgcaagttctgtaatacccaaaccgggcgccccttacctttagacccggatgaacccacccacgttgccgaatctattgcattaatgaagctgtcacatgcagtcattacaagcgtagaccgtgacgaccttccggacttaggagcagcacattgggctcagactatccgcgagatcaagcgtttgaatccggaaactaccacagaggttttaattcctgactttcagggacgtaaggaacttatcgaccaagtcattaaggcgtgtcccgaaattatttcacataacatggaaacggtcaaacgcatttcgccgcaggttcgttctgcagcgaattaccacactagtcttgaagtcattcgtcagattgctgaaagcgggatcactgctaaatcgggcattatggttgggttgggtgagactcccgccgaagtcgaagagcttatggacgacttgatctcagtcggttgcaaaatcctgaccatcggtcaatatcttcaacctacacataagcatttcccggttgctgcttacattaccccagaacagttcgccgtctataaggagacgggcttgaagaaaggttttgagcaggtggagtcagcgccccttgtgcgctcttcttatcacgcagaaaaacacatccgctttaataacaagtaa

SEQ ID NO: 111 - protein, 288 aa, Bacteroides fragilis 638R
MGNDKRVRKPEWLKISIGANERYTETKRIVESHCLHTICSSGRCPNMGECWGKGTATFMIAGDICTRSCKFCNTQTGRPLPLDPDEPTHVAESIALMKLSHAVITSVDRDDLPDLGAAHWAQTIREIKRLNPETTTEVLIPDFQGRKELIDQVIKACPEIISHNMETVKRISPQVRSAANYHTSLEVIRQIAESGITAKSGIMVGLGETPAEVEELMDDLISVGCKILTIGQYLQPTHKHFPVAAYITPEQFAVYKETGLKKGFEQVESAPLVRSSYHAEKHIRFNNK

SEQ ID NO: 112 - DNA, 954 bp, Streptomyces coelicolor A3(2)
  CDS (1)..(954): lipA gene encoding a lipoic acid synthase (LipA)
atgagcgcggtagctcctgacggccgcaagatgctgcgtttggaggttcgtaacagccaaacgcctatcgaacgcaagcccgagtggatcaagactcgtgctaagatgggtcccgaatacacgaagatgcagaacttggtcaagtcggagggcttacatacggtatgccaggaagctgggtgccccaacatttatgagtgctgggaggatcgtgaagcaacgtttttgatcggaggcgatcagtgcactcgtcgctgcgacttttgtcaaatcgatacaggaaaacctgaagcccttgatcgtgatgagccacgtcgtgtaggagaatcggtcgtcacaatggatcttaactatgctaccattactggcgttgcacgtgatgatctgcccgatggtggagcttggctttacgctgaaactgttcgtcagatccatgaacagactgcgggtcgcgaagccgggcgtaccaaagttgaacttcttgcacctgattttaacgcggtgccagagctgttacgcgaagtctttgaatcgcgccctgaagtcttcgctcacaatgtagagacagtaccacgcatctttaagcgtattcgtccagggtttcgctatgagcgcagtcttaaggttatcactgatgcgcgtgattttggattggtcaccaaatcgaaccttatcttgggaatgggggaaacacgcgaggaaatttcggaagccttaaaacagctgcatgaagcgggttgcgagcttattacaatcacccagtatcttcgtcctagtgtccgtcatcatccggtcgaacgctgggtaaaaccccaggaatttgtggaacttaaggaggaggcggagcaaattggcttttcgggtgtaatgtcaggcccccttgtgcgttcctcgtaccgtgcggggcgcttgtacggaatggctatggaacagcgccgttccgcaaccgtttga

SEQ ID NO: 113 - protein, 317 aa, Streptomyces coelicolor A3(2)
MSAVAPDGRKMLRLEVRNSQTPIERKPEWIKTRAKMGPEYTKMQNLVKSEGLHTVCQEAGCPNIYECWEDREATFLIGGDQCTRRCDFCQIDTGKPEALDRDEPRRVGESVVTMDLNYATITGVARDDLPDGGAWLYAETVRQIHEQTAGREAGRTKVELLAPDFNAVPELLREVFESRPEVFAHNVETVPRIFKRIRPGFRYERSLKVITDARDFGLVTKSNLILGMGETREEISEALKQLHEAGCELITITQYLRPSVRHHPVERWVKPQEFVELKEEAEQIGFSGVMSGPLVRSSYRAGRLYGMAMEQRRSATV

SEQ ID NO: 114 - DNA, 642 bp, Escherichia coli
  CDS (1)..(642): lipB encoding octanoyltransferase (LipB)
atgtatcaggataaaattcttgtccgccagctcggtcttcagccttacgagccaatctcccaggctatgcatgaattcaccgatacccgcgatgatagtacccttgatgaaatctggctggtcgagcactatccggtattcacccaaggtcaggcaggaaaagcggagcacattttaatgccgggtgatattccggtgatccagagcgatcgcggtgggcaggtgacttatcacgggccggggcaacaggtgatgtatgtgttgcttaacctgaaacgccgtaaactcggtgtgcgtgaactggtgaccttgcttgagcaaacagtggtgaataccctggctgaactgggtatagaagcgcatcctcgggctgacgcgccaggtgtctatgttggggaaaagaaaatttgctcactgggtttacgtattcgacgcggttgttcattccacggtctggcattaaacgtcaatatggatctttcaccatttttacgtattaatccttgtgggtatgccggaatggaaatggctaaaatatcacaatggaaacccgaagcgacgactaataatattgctccacgtttactggaaaatattttagcgctactaaacaatccggacttcgaatatattaccgcttaa

SEQ ID NO: 115 - protein, 213 aa, Escherichia coli
MYQDKILVRQLGLQPYEPISQAMHEFTDTRDDSTLDEIWLVEHYPVFTQGQAGKAEHILMPGDIPVIQSDRGGQVTYHGPGQQVMYVLLNLKRRKLGVRELVTLLEQTVVNTLAELGIEAHPRADAPGVYVGEKKICSLGLRIRRGCSFHGLALNVNMDLSPFLRINPCGYAGMEMAKISQWKPEATTNNIAPRLLENILALLNNPDFEYITA

SEQ ID NO: 116 - DNA, 576 bp, Shigella flexneri
  CDS (1)..(576): lipB gene encoding a octanoyltransferase (LipB)
atgcatgaattcaccgatacccgcgataatagtacccttgatgaaatctggctggtcgagcactatccggtattcacccaaggtcaggcaggaaaagcggagcacattttaatgccgggtgatattccggtgatccagagcgatcgcggtgggcaggtgacttatcacgggccgggacaacaggtgatgtatgtgttgcttaacctgaaacgccgtaaactcggtgtgcgtgaactggtgaccttgcttgagcaaacagtggtgaataccctggctgaactgggtatagaagcgcatcctcgggctgacgcgcctggtgtctatgtcggggaaaagaaaatttgctcactgggtttacgaattcgacgcggttgttcattccacggtctggcattaaacgtcaatatggatctttcaccatttttacgtattaatccttgtgggtatgccggaatggaaatggctaaaatatcacaatggaaacccgaagcgacgactaataatattgctccacgtttactggaaaatattttagcgctactaaacaatccggacttcgaatatattaccgcttaa

SEQ ID NO: 117 - protein, 191 aa, Shigella flexneri
MHEFTDTRDNSTLDEIWLVEHYPVFTQGQAGKAEHILMPGDIPVIQSDRGGQVTYHGPGQQVMYVLLNLKRRKLGVRELVTLLEQTVVNTLAELGIEAHPRADAPGVYVGEKKICSLGLRIRRGCSFHGLALNVNMDLSPFLRINPCGYAGMEMAKISQWKPEATTNNIAPRLLENILALLNNPDFEYITA

SEQ ID NO: 118 - DNA, 1893 bp, Escherichia coli
  CDS (1)..(1893): aceF gene encoding dihydrolipoyllysine-residue acetyltransferase component of pyruvate dehydrogenase (E2)
atggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagttccgtctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcggcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggcagctccggccgctaaacaggaagcagctccggcagcggcccctgcaccagcggctggcgtgaaagaagttaacgttccggatatcggcggtgacgaagttgaagtgactgaagtgatggtgaaagtgggcgacaaagttgccgctgaacagtcactgatcaccgtagaaggcgacaaagcttctatggaagttccggcgccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggcaccggcagcaaaagctgaagccccggcagcagcaccagctgcgaaagcggaaggcaaatctgaatttgctgaaaacgacgcttatgttcacgcgactccgctgatccgccgtctggcacgcgagtttggtgttaaccttgcgaaagtgaagggcactggccgtaaaggtcgtatcctgcgcgaagacgttcaggcttacgtgaaagaagctatcaaacgtgcagaagcagctccggcagcgactggcggtggtatccctggcatgctgccgtggccgaaggtggacttcagcaagtttggtgaaatcgaagaagtggaactgggccgcatccagaaaatctctggtgcgaacctgagccgtaactgggtaatgatcccgcatgttactcacttcgacaaaaccgatatcaccgagttggaagcgttccgtaaacagcagaacgaagaagcggcgaaacgtaagctggatgtgaagatcaccccggttgtcttcatcatgaaagccgttgctgcagctcttgagcagatgcctcgcttcaatagttcgctgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctgggtactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaa

SEQ ID NO: 119 - protein, 630 aa, Escherichia coli
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAAAPAAKQEAAPAAAPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 120 - DNA, 1890 bp, Klebsiella oxytoca
  CDS (1)..(1890): aceF gene encoding dihydrolipoyllysine-residue acetyltransferase component of pyruvate dehydrogenase (E2)
atggctatcgagatcaaggtgcccgacatcggcgctgacgaagtagaaattaccgagatcctggttaaagtcggtgataaggtagaggcagaacagagtttaatcactgtagaaggcgataaggcatccatggaggtaccatcaccgcaagctggtgtagttaaagagatcaaagtgagtgtaggcgacaaaactgaaaccggtaagttaattatgatcttcgattcagccgacggggcagccgccgctgctcccgcacaggaagagaaaaaggaggcggcacctgccgctgcagcaccagcagccgcttctgcaaaagaggtgcatgtacctgacattggaggcgacgaagtagaagtaacagagattatggtcaaggttggcgatacaatcgcagcggaacaaagcttaattacggtagaaggcgataaagcaagcatggaagttcccgctcccttcgctgggactgtaaaagaaatcaagattaacaccggcgacaaggtttccaccggctcattaattatgatcttcgaagtagcaggagctgcacctgcggcagcgcctgcgaaagcggaggctgcacctgcagcggcggctcccgccgctagtggtagtaaagaagtgcacgttccggacatcggaggtgacgaggtcgaagtcactgaagtgatggtaaaagcaggggataaaatcgcagccgagcagagtttaattacagtcgaaggcgataaggcgtctatggaagttccagcgccattcgccggtacagtaaaggaaattaagatcagcactggagataaagtctcaactggttcattgatcatggtcttcgaagtcgaaggcgccgcacctgcggcggcaccggcagcggctgccgctccagcaccagctgctgcgcccgcacaagctgcaaaaccagctgcccccgcagcgaaggccgaaggcaagagcgagttcgcagagaatgatgcgtacgtacatgcgacaccattgattcgccgtttggcacgcgaattcggtgtgaacctggctaaagtgaagggaacggggcgcaaaggccgcattttgcgtgaggacgtccaggcttatgttaaagaagcagtcaagcgtgccgaagcagcgccagccgcaaccggcggggggatcccaggcatgttaccctggccaaaggtagacttttcaaaatttggggaggtagaagaggttgagttgggacgcatccagaagatctccggtgcaaatttgtcgcgcaactgggtcatgattccgcacgtcactcactttgacaaaacggacattaccgatttggaggcttttcgtaagcaacaaaatgctgaggcggagaagcgtaaattggacgtgaagttcaccccggtggtgttcattatgaaggcagtggccgcagcacttgaacagatgccgcgtttcaactcatccctgtcagaggatgctcaacgtcttaccttaaagaagtacatcaacattggtgttgctgtggacacgccaaatgggttggtagtccccgtgtttaaagacgttaataagaagtccattacagagttatcgcgcgaattaactgttatcagcaagaaagcacgcgatgggaagctgactgccggcgaaatgcaaggcggatgttttaccatctcgagtattgggggattagggaccacacattttgcacccatcgtcaatgcacctgaagtagctatcttaggggtatcaaaatcagcgatggagccggtttggaatgggaaagagttcgtaccccgtctgatgatgccaatttcactgtcattcgaccatcgcgtcattgatggcgcggatggcgcacgctttatcacaattatcaataatatgctttcagatattcgccgtttagtcatgtaa

SEQ ID NO: 121 - protein, 629 aa, Klebsiella oxytoca
MAIEIKVPDIGADEVEITEILVKVGDKVEAEQSLITVEGDKASMEVPSPQAGVVKEIKVSVGDKTETGKLIMIFDSADGAAAAAPAQEEKKEAAPAAAAPAAASAKEVHVPDIGGDEVEVTEIMVKVGDTIAAEQSLITVEGDKASMEVPAPFAGTVKEIKINTGDKVSTGSLIMIFEVAGAAPAAAPAKAEAAPAAAAPAASGSKEVHVPDIGGDEVEVTEVMVKAGDKIAAEQSLITVEGDKASMEVPAPFAGTVKEIKISTGDKVSTGSLIMVFEVEGAAPAAAPAAAAAPAPAAAPAQAAKPAAPAAKAEGKSEFAENDAYVHATPLIRRLAREFGVNLAKVKGTGRKGRILREDVQAYVKEAVKRAEAAPAATGGGIPGMLPWPKVDFSKFGEVEEVELGRIQKISGANLSRNWVMIPHVTHFDKTDITDLEAFRKQQNAEAEKRKLDVKFTPVVFIMKAVAAALEQMPRFNSSLSEDAQRLTLKKYINIGVAVDTPNGLVVPVFKDVNKKSITELSRELTVISKKARDGKLTAGEMQGGCFTISSIGGLGTTHFAPIVNAPEVAILGVSKSAMEPVWNGKEFVPRLMMPISLSFDHRVIDGADGARFITIINNMLSDIRRLVM

SEQ ID NO: 122 - DNA, 1017 bp, Escherichia coli
  CDS (1)..(1017): lplA gene encoding lipoate-protein ligase A (LplA)
atgtccacattacgcctgctcatctctgactcttacgacccgtggtttaacctggcggtggaagagtgtatttttcgccaaatgcccgccacgcagcgcgttctgtttctctggcgcaatgccgacacggtagtaattggtcgcgcgcagaacccgtggaaagagtgtaatacccggcggatggaagaagataacgtccgcctggcgcggcgcagtagcggtggcggcgcggtgttccacgatctcggcaatacctgctttacctttatggctggcaagccggagtacgataaaactatctccacgtcgattgtgctcaatgcgctgaacgcgctcggcgtcagcgccgaagcgtccggacgtaacgatctggtggtgaaaaccgtcgaaggcgaccgcaaagtctcaggctcggcctatcgcgaaaccaaagatcgcggcttccaccacggcaccttgctactcaatgccgacctcagccgcctggcaaactatctcaatccggataaaaagaaactggcggcgaaaggcattacgtcggtacgttcccgcgtgaccaacctcaccgagctgttgccggggatcacccatgagcaggtttgcgaggccataaccgaggcctttttcgcccattatggcgagcgcgtggaagcggaaatcatctccccgaacaaaacgccagacttgccaaacttcgccgaaacctttgcccgccagagtagctgggaatggaacttcggtcaggctccggcattctcgcatctgctggatgaacgctttacctggggcggcgtggaactgcatttcgacgttgaaaaaggccatatcacccgcgcccaggtgtttaccgacagcctcaaccccgcgccgctggaagccctcgccggacgactgcaaggctgcctgtaccgcgcagatatgctgcaacaggagtgcgaagcgctgttggttgacttcccggaacaggaaaaagagctacgggagttatcggcatggatggcgggggctgtaaggtag

SEQ ID NO: 123 - protein, 338 aa, Escherichia coli
MSTLRLLISDSYDPWFNLAVEECIFRQMPATQRVLFLWRNADTVVIGRAQNPWKECNTRRMEEDNVRLARRSSGGGAVFHDLGNTCFTFMAGKPEYDKTISTSIVLNALNALGVSAEASGRNDLVVKTVEGDRKVSGSAYRETKDRGFHHGTLLLNADLSRLANYLNPDKKKLAAKGITSVRSRVTNLTELLPGITHEQVCEAITEAFFAHYGERVEAEIISPNKTPDLPNFAETFARQSSWEWNFGQAPAFSHLLDERFTWGGVELHFDVEKGHITRAQVFTDSLNPAPLEALAGRLQGCLYRADMLQQECEALLVDFPEQEKELRELSAWMAGAVR

SEQ ID NO: 124 - DNA, 1017 bp, Klebsiella oxytoca
  CDS (1)..(1017): lplA gene encoding lipoate-protein ligase A (LplA)
atgtcaaccttgcgtttgctgttatccgacagttatgacccatggtttaaccttgccgtagaggagtccattttccgccagatgccagcgacacagcgtgtcttgtttttgtggcgtaacgccgataccgtagttatcggacgcgcacagaatccatggaaggagtgtaacacacgtcgcatggaggaggacaatgtgcgtctggctcgtcgctcttccgggggaggtgctgtgtttcatgaccttggcaatacctgctttacattcatggcggggaagcctgaatacgacaaaacagtgtctacgaacatcgtcctgactgcgctgaacgcgttaggggttgctgcagaagcgtctgggcgtaatgatttagtagtcaagactgctgagggagaccgcaaggtttcgggttcagcgtaccgcgaaacaatggatcgtggctttcatcatggtactttgctgttaaatgcggatctttcccgcctggcgaactacttgaacccggacaagaaaaaacttcaagcaaagggcatcacatcggtccgcggccgtgtcgctaatcttgtcgagctgttaccaggcatcacccaccagcaagtatgcgaggccatccaggaagcattcttcgcccactatggcgagcgcgtggaggcagaggtaatctcacctgaaaaaatgcctgacctgcctaatttcgccgctaccttcgctcgccagtcgtcgtgggaatggaacttcggccaagctccagcctttagtcacctgcttgacgaacgcttcacatggggaggcgttgagcttcatttcgacgtggagaagggacacatcacacgcacccagatttttaccgacagccttaacccagcaccgctggaggctttggccgcccgcttacaaggttgcctttatcgcgccgacatgctgcaacaagagtgcgatgctctgttagtagactttccagagcaggagaaagcattacgtgagctgtcagcctggattgctggtgcagtacgttaa

SEQ ID NO: 125 - protein, 338 aa, Klebsiella oxytoca
MSTLRLLLSDSYDPWFNLAVEESIFRQMPATQRVLFLWRNADTVVIGRAQNPWKECNTRRMEEDNVRLARRSSGGGAVFHDLGNTCFTFMAGKPEYDKTVSTNIVLTALNALGVAAEASGRNDLVVKTAEGDRKVSGSAYRETMDRGFHHGTLLLNADLSRLANYLNPDKKKLQAKGITSVRGRVANLVELLPGITHQQVCEAIQEAFFAHYGERVEAEVISPEKMPDLPNFAATFARQSSWEWNFGQAPAFSHLLDERFTWGGVELHFDVEKGHITRTQIFTDSLNPAPLEALAARLQGCLYRADMLQQECDALLVDFPEQEKALRELSAWIAGAVR

SEQ ID NO: 126 - DNA, 1854 bp, Arabidopsis thaliana
  CDS (1)..(1854): Arabidopsis thaliana gene encoding TMP phosphatase [AT5G32470.1]
atgcgcttcctcttccccacgcgcctcatcaacaactcatctctcggtctcctccgatctccacacaccaccgcgccgatccgttctctctggtttcgcaccaagtctccggtcttccgatcggcgactactccaataatgacggcggtcgctttctcttcatcgttgtcgattccccctacctcggaagaagcacttccagggaagctatggatcaagtttaacagagagtgtctcttctctatctatagccccttcgccgtctgtttagccgccggaaatctcaagatcgacacatttcgtcagtatattgcacaggatgttcatttccttaaggcctttgctcacgcgtatgaactggccgcagattgtgctgatgacgatgatgataaattggcaatttctgatttgaggaaaagcgtgatggaagaattgaaaatgcacgactcatttgtacaggattgggatttagacatcaacaaagaagtaagtgttaactcagcaactttgagatacactgagttcttgttagctacagcatccggaaaagtagaaggatgcaaagctcccggcatgcttgatactccatttgaaaaaacaaaagttgctgcctacacgcttggtgctgtgacaccttgcatgcggttgtatgcctttctcggtaaggagtttggatcacttcttgatctgagtgatgtgaaccatccctacaagaaatggatcgataattattctagtgatgctttccaggcatcagccaagcaaactgaagacttgcttgagaagcttagtgtctctatgactggtgaagaattggacataattgaaaaattgtatcaacaggctatgaaacttgaagtagagttcttccatgcccagccacttgcccagcctaccatagttccactgctcaagaaccactcaaaagatgatctggtgatcttttctgattttgatctgacttgcaccgttgtggattcttctgctattttagcggaaatagcaattgtaactgccccaaaagatgaacaaagtcgatctggacaacaaattcatcggatgctctcatctgaccttaagaacacctggaatctactttctaaacaatacacagagcattatgaagaatgcatagagagtattctgaataaaaagaaagcggacaagtttgactatgaaggtttatgtaaagcactagagcagctttcagattttgagaaagaggcaaataatcgagtgattgagtctggtgtactcaaaggcctgaatcttgaagacattaagcgcgctggggaaaggttaatccttcaagatggatgcatcaatgtcttccagaaaattttaaagactgagaatctgaatgcagaacttcatgtgctttcctattgttggtgtggtgacctcatcagggcagccttttctgcaggcggagtagatgcagtggaagtacatgcaaatgaattcacatttgaggaatccatctcgactggtgagatcgaaagaaaggtggaatccccaattaacaaagctcaacagttcaaaagtatcctacaaaacagaaagaatgagaacaataagaaaagtttcttgagtgtgtatattggagattcggtaggtgacttgctgtgtctcctcgaagcagatataggaatagtggttagctctagctcgagtctcaggagagttggaagccattttggggtctcatttgtgcctttgttttctggaatcgtccagaaacagaaacaacacactgaagaatcatcatcatcagcatggaaaggactctctggcacactttacacagtttcaagctgggccgaaattcattcattcgctcttggatgggagtaa

SEQ ID NO: 127 - protein, 617 aa, Arabidopsis thaliana
MRFLFPTRLINNSSLGLLRSPHTTAPIRSLWFRTKSPVFRSATTPIMTAVAFSSSLSIPPTSEEALPGKLWIKFNRECLFSIYSPFAVCLAAGNLKIDTFRQYIAQDVHFLKAFAHAYELAADCADDDDDKLAISDLRKSVMEELKMHDSFVQDWDLDINKEVSVNSATLRYTEFLLATASGKVEGCKAPGMLDTPFEKTKVAAYTLGAVTPCMRLYAFLGKEFGSLLDLSDVNHPYKKWIDNYSSDAFQASAKQTEDLLEKLSVSMTGEELDIIEKLYQQAMKLEVEFFHAQPLAQPTIVPLLKNHSKDDLVIFSDFDLTCTVVDSSAILAEIAIVTAPKDEQSRSGQQIHRMLSSDLKNTWNLLSKQYTEHYEECIESILNKKKADKFDYEGLCKALEQLSDFEKEANNRVIESGVLKGLNLEDIKRAGERLILQDGCINVFQKILKTENLNAELHVLSYCWCGDLIRAAFSAGGVDAVEVHANEFTFEESISTGEIERKVESPINKAQQFKSILQNRKNENNKKSFLSVYIGDSVGDLLCLLEADIGIVVSSSSSLRRVGSHFGVSFVPLFSGIVQKQKQHTEESSSSAWKGLSGTLYTVSSWAEIHSFALGWE

SEQ ID NO: 128 - DNA, 1806 bp, Pyrus x bretschneideri
  CDS (1)..(1806): Pyrus x bretschneideri gene encoding TMP phosphatase [XP_009379735.1]
atgcgcatactcttccccccaaacccaatcaaaaccccaactctcttcaactccctccgtctgcgattcaactcgctccgatcccactgtgccaactcaatggccgtacctccgccgaagtcagccatggcttccgccgtcgtcggcaacgaggtgggtctcgcccgccgcttctggatcaagttcaagcgagaatcgattttcgctatgtacactcccttcacgctctgtttggctgctgggaatctcaagattgaaactttccgcgattatattgcccaagatgttcactttctcaaggccttcgctcacgcgtatgaattggcagaagattgtgcagacgatgatgatgcaaagcccgtgatttctgagttgaggagggcagttctgcaggagctgaaaatgcatgattcatttgtgaaggaatgggggttacagggtgctaaagagacccctatcaactccgctgcggtgaagtacacagatttcttattggcaacagcctctggaaaagttgaaggagtcaagggacctggtaaacttgcaactccatttgaaagaaccaaagtggctgcttacacccttggcgctatgactccttgcatgagactgtatgcctttcttggtaaggagttcaaggcacttctagatcccagcgaaggcagtcacccgtacttgaagtggattgacagttattcttctaaaagttttcaggcatcagctgtgcaaatcgaagagttgctggataaactaagtgtctctttgacaggcgaggagcttgacatcatcgaaaagctttaccaccaagcaatgaaacttgagatcgagttcttctctgctcagtctcttgttcagccaactgtagttcctctgatcagagaacataaccctgcagaagatcggctcatgatattttctgattttgatttgacttgtacagtcgttgattcatctgccattttggctgaaattgcaatagtaacagcaccaaaatctgatcaacatcaacccgaaaatcagattgctcggatgtcttcggctgatctcaggaatacatggggtcttctttccaggcagtacacagaagagtatgagcaatgcatagaaagcattgttcccactgaaaaagcagtgtttgactatgaaaatttgcttaaagcactagagaaactttcagattttgagaggaaggcaaacaatagagtcacgaagtctgaagtactcaagggtcttaatctcgaagatataaaaagagctggtgaacgtctcattcttcaagatggctgtattaatttctttcagaaaattgccaagagtgaaaacttgaatgcaaatgttcatgttctttcatactgttggtgtggtgatctcataagatcggccttttcatcagggggtttaaacgagctggatgtacatgcaaatgagtttaccttcgaggaatccatctccacaggtgatattgttaagaaggtggagtcccctattgacaaggttaaatcttttaaagatattttgaaaaattgcagcaatgacagaaagaacttgactgtttacattggagactcggtgggtgacttactttgtctgctggaggcggatattggaatcgtaattgggtcaagttcaagccttaggagagtggcgactcagtttggggtatcttttgttccgttgttcccgggtttagttaagaaacagaaagaatgcacagatggaaggtctcctagttggaaagggttaactggtattctttacacagtgaatagttgggcggaaatacatgccttcattttggggtgttaa

SEQ ID NO: 129 - protein, 601 aa, Pyrus x bretschneideri
MRILFPPNPIKTPTLFNSLRLRFNSLRSHCANSMAVPPPKSAMASAVVGNEVGLARRFWIKFKRESIFAMYTPFTLCLAAGNLKIETFRDYIAQDVHFLKAFAHAYELAEDCADDDDAKPVISELRRAVLQELKMHDSFVKEWGLQGAKETPINSAAVKYTDFLLATASGKVEGVKGPGKLATPFERTKVAAYTLGAMTPCMRLYAFLGKEFKALLDPSEGSHPYLKWIDSYSSKSFQASAVQIEELLDKLSVSLTGEELDIIEKLYHQAMKLEIEFFSAQSLVQPTVVPLIREHNPAEDRLMIFSDFDLTCTVVDSSAILAEIAIVTAPKSDQHQPENQIARMSSADLRNTWGLLSRQYTEEYEQCIESIVPTEKAVFDYENLLKALEKLSDFERKANNRVTKSEVLKGLNLEDIKRAGERLILQDGCINFFQKIAKSENLNANVHVLSYCWCGDLIRSAFSSGGLNELDVHANEFTFEESISTGDIVKKVESPIDKVKSFKDILKNCSNDRKNLTVYIGDSVGDLLCLLEADIGIVIGSSSSLRRVATQFGVSFVPLFPGLVKKQKECTDGRSPSWKGLTGILYTVNSWAEIHAFILGC

SEQ ID NO: 130 - DNA, 1797 bp, Brassica napus
  CDS (1)..(1797): Brassica napus gene encoding TMP phosphatase [CDY62623.1]
atgcgcatcctcaacaactcgctcgcccttctccgatcgccccgcgccgccgccccgatccgttctctactgttcggcagcaagaagtcttccgtctcccgatcggcggccgccttctcttcggcgatgtcgattcctcctcctagcatatccacctcggaagaagctctggcggggaggctgtggatcaagttcaacagagagtgcctcttctctatgtacagccccttcgccgtttctttggccgccggcaatctcaagatcgagaccttccggcagtatattgctcaggatgttcatttcctcaaggcctttgctcacgcgtatgagttggccgcagagtgtgctgatgatgatgatgataagttggcaatttctgacttgaggaaaagcgtcatggatgagttgaaaatgcacaactcatttgtacaggattgggatttagacatcagcaaagaagtaagtgttaactcagcaacattgagatacaccgagttcttattagctacatcatccggaaaagtagaaggactcaaagctcccggcatgcttgatactccatttgagaaaaccaaagtggccgcctacacgcttggtgctgtgacaccttgcatgaagctgtatgcctttcttggtaaggagtttggagcgcttctagattcgagtgaagcgaaccatccctacaagaaatggatcgaaaattattctagtgatgcattccaggcatcagctaagcaaactgaagacttgcttgagaagcttagtgtgtgtatgactggcgaagagctggacatcattgaaaaactgtatcaacaggcaatgaaacttgaagtagagttcttccacgcacaaccgtttgctcagcctaccatagttccgctgctgaagaaccattcaaaagatgagctgatgatattttctgattttgatctgacttgcaccgttgttgattcttctgctattttagccgaaattgcaatcgtaactgccccgaaagatgatcagggtcaacaaattaatcggatgctttcggctgaccttaagaacacctggagtctactttccaaacagtatacagagcactatgaagagtgcatagagagtattctgaataaggaaaaagcggacaagtttgactacgagggtttgtgtgaagcactagagcagctgtcagagtttgagaagaaagcaaacgaccgagtgatagagtctggtgtactcaagggcctgaatctcgatgacatcaagcgagctggggaaaggttgattcttcaagatggctgcatcaatgtcttccagaaaattttgaagactcaggatgtgaatgcaaaactccacgtgctttcgtattgttggtgtggtgacctcatcagagcagccttttctgcacggggagtagatgcagtggaagtacatgcaaatgaattcacattcgaggaatccatctctactggagaaatagaaagaaaagtggaatccccaatcgacaaggctcaacagttcaagagcatcctacaaaacagaaagaaggatgaggagaaaagcatcctcactgtttacattggagattcagtaggtgacttgctctgtctcctggaggcagacattggaatagtggtcgcctctagctcgagcctcaggagagtgggaagccatttcggggtctcatttgtgcctttgttctctggaattgtgcaaaaacagaaacaagaagaaacctggaaggggctctctggcacactttacacggtatcaagctgggctgaaatacattccttcgctcttggatgggagtaa

SEQ ID NO: 131 - protein, 598 aa, Brassica napus
MRILNNSLALLRSPRAAAPIRSLLFGSKKSSVSRSAAAFSSAMSIPPPSISTSEEALAGRLWIKFNRECLFSMYSPFAVSLAAGNLKIETFRQYIAQDVHFLKAFAHAYELAAECADDDDDKLAISDLRKSVMDELKMHNSFVQDWDLDISKEVSVNSATLRYTEFLLATSSGKVEGLKAPGMLDTPFEKTKVAAYTLGAVTPCMKLYAFLGKEFGALLDSSEANHPYKKWIENYSSDAFQASAKQTEDLLEKLSVCMTGEELDIIEKLYQQAMKLEVEFFHAQPFAQPTIVPLLKNHSKDELMIFSDFDLTCTVVDSSAILAEIAIVTAPKDDQGQQINRMLSADLKNTWSLLSKQYTEHYEECIESILNKEKADKFDYEGLCEALEQLSEFEKKANDRVIESGVLKGLNLDDIKRAGERLILQDGCINVFQKILKTQDVNAKLHVLSYCWCGDLIRAAFSARGVDAVEVHANEFTFEESISTGEIERKVESPIDKAQQFKSILQNRKKDEEKSILTVYIGDSVGDLLCLLEADIGIVVASSSSLRRVGSHFGVSFVPLFSGIVQKQKQEETWKGLSGTLYTVSSWAEIHSFALGWE

SEQ ID NO: 132 - DNA, 1815 bp, Glycine max
  CDS (1)..(1815): Glycine max gene encoding TMP phosphatase [XP_003536133.1]
atgcgcatgcggtggttcctccgaagcccaatcatcaaaacctcgctgctgaatctgagccctccaatttcgtttagacctcactgggcgaggaggaccttcacttcttcgagattgtcaatggcggccatccacaaccacagcaacagcaacagcgaaaccggactcgcgagacggttttggatcaagttcactcgtgaatccatcttcgccatgtacactcccttcgccatcgccttggcctccggtaatttgcacattgattccttccaccattacatcgcccaagacgttcatttcctacgcgcctttgctcaagcgtatgagttggctgaagagtgtgctgatgacgacgatgcgaaacttggaatctgtgagttgaggaaggcagttctagaggagctgaagatgcacaacttgctggtacaggaacgggagttggaccttgccaaagagcatggtattaattctgcaactgttaagtacacagagttcctgctggctacagcctctgggaagattgaaggactaaaaggtcctggtaaacttgctacaccatttgagaaaacaaaaattgctgcttatactttaggtgccatgactccttgcatgaggctttatgccgttatgggaaagaagttccaggaacttttggattccaatgaaagtactcacccatataacaagtggatcaacaactattcctctgatggtttccaggctactactctgcaaactgaagatttgctcgacaaactaagtgtctctttgactggtgaagaacttgatgtcattgaaaagctttattaccaagcaatgaagcttgaaatagagttcttctctgctcagccactcttccagccaactatagtacccttgactaaaggacataagcctgtggaagatcatctcattattttttctgattttgatttaacatgcaccgtagttgattcgtccgccatcttggctgaaattgccatagtgacggcaccaaaatctgatcagaatcagcctgaagatcaaattgttcggatgttatcttctgacctcaggaatacatggggttttctatctaaacagtatacggaggagtatgagcaatgtatagaaagcattatgcctcccgatagattgaacaatttcgattacaaagaattgtcgatggcccttgagcaactttcaaaatttgagaacactgcaaataatagggttatcgagtcaggggtactcaagggtataagtctagaagatataaagcgtgctggagagcgtctgatactacaagatggttgccctaacttctttcagagcattgttaagaatgaaaatttgaatgccaacgtgcatgttctttcatactgctggtgtggtgacctcattaggtctactttctcttccgctgatttaaatgagttgaatgttcatgctaatgagttcacttatgagggatctgtttccacgggtgaaattgttaagaaagtggagtctcccattgacaaggttgaagcttttcgtaacatattgaaaaattgcaatgatgacaaaaagaaattaactgtttacattggcgattcagtgggtgatttactttgcctacttgaagctgatgtaggaattgtgattggttcaagttcaagccttagaagtgtagggacgcagtttggtatttcatttgtcccattgtattctggcttggttaagaaacagaaagaatatgttgaaggaagcacttctgattggaagggtttatctggcattctttacacagtctctagttgggctgaagtgcatgcttttattttgggttgctag

SEQ ID NO: 133 - protein, 604 aa, Glycine max
MRMRWFLRSPIIKTSLLNLSPPISFRPHWARRTFTSSRLSMAAIHNHSNSNSETGLARRFWIKFTRESIFAMYTPFAIALASGNLHIDSFHHYIAQDVHFLRAFAQAYELAEECADDDDAKLGICELRKAVLEELKMHNLLVQERELDLAKEHGINSATVKYTEFLLATASGKIEGLKGPGKLATPFEKTKIAAYTLGAMTPCMRLYAVMGKKFQELLDSNESTHPYNKWINNYSSDGFQATTLQTEDLLDKLSVSLTGEELDVIEKLYYQAMKLEIEFFSAQPLFQPTIVPLTKGHKPVEDHLIIFSDFDLTCTVVDSSAILAEIAIVTAPKSDQNQPEDQIVRMLSSDLRNTWGFLSKQYTEEYEQCIESIMPPDRLNNFDYKELSMALEQLSKFENTANNRVIESGVLKGISLEDIKRAGERLILQDGCPNFFQSIVKNENLNANVHVLSYCWCGDLIRSTFSSADLNELNVHANEFTYEGSVSTGEIVKKVESPIDKVEAFRNILKNCNDDKKKLTVYIGDSVGDLLCLLEADVGIVIGSSSSLRSVGTQFGISFVPLYSGLVKKQKEYVEGSTSDWKGLSGILYTVSSWAEVHAFILGC

SEQ ID NO: 134 - DNA, 1845 bp, Nicotiana tomentosiformis
  CDS (1)..(1845): Nicotiana tomentosiformi gene encoding TMP phosphatase [XP_009615535.1]
atgcgcttctcattattatcgccccttgttcttaacccagtcatcagattctccaattccaacgcgctttttgggttacgattccaattataccctcgttactctcggtatttacgatcgcccgttacaatggcgtcggcgaaaccaaagccggcggcggcggtgaacaagtttccggtagaggaggaatgtgtgggtatagcgaggaagtgttggatcaagttcaagagagagtctactttcgctctgtacactccgtttgtggttagtttggcatcaggaaccctaaatctggacactttccgccattacattgctcaggatgttcacttcctcaaatccttcgctcaagcgtatgaagctgcagaagagtgtactgacgatgacgatgcgaaggttggcattagtgagttgcggaagaatgttattgaagaacttaaaatgcatgatgcagttttaaaagagtggggcattgatctggtcaaagagtccagtcttaaccctgcaacggccaagtacacagattttttatcagctacagcttcaggaaaggtggaaggagtaaaagctgctaaacttgccacaccatttgagagaacgaagttggcagcttatactctaggtgctatgactccttgcatgaggctttacgcctacattggtaaggagctgcaagtgttcctcgagggagagaaaattcatccatacaagaagtggattgacagttatgcctctgaaagtttccaggcatcagctcttcaaaccgaggacttgttggataaactgagtgtccctttgacaggcgaggagcttgacatcattgaaaagctttatcatcaagcaatgaaacttgaaattgatttcttcttaacccagccacttgttcagaaagctgtcatccctttgtcaaaagatcacaaccctgctgaacaccggcttacaatattttctgatttcgatttgacgtgcactgttgttgattcttctgccatcttggctgaaattgcaattataacagcaccgagatctgatcaaaatcgaccagagaatcaaattgcgcggatgttgtcggctgatttgaggaatacatggggagatctctctaagcagtacactgaagagtatgagcaatgtatagagaagatgttacttactgaaaaagcggaaaaatttgattatgaaagactgcataaaacacttgaggaactttctgattttgagaaaagagcaaatactagggtgactgaatctggggtactgaaaggtttaaaccttgaagacataaaacgagctgggcagcgattgattctccaggatggttgcaccaacttcttccagagcataataagaaatgaaaatctgaacgcagacattcatgtcctctcctattgctggtgtggcgaccttattaggtcttccttttcatcagggggtatagacgctctgaatgtgcatgccaatgagtttatgtttcaagaatctctatccactggtgaaattgttaagaaagttgaatcccccattgacaaggttcaagcattcagtaaaattcgaatgaactgtggcaatgaccaaaaaaatctgactctttatattggggattcagtcggcgacttactttgcttgcttgaagcagatgttggcatagtgcttggtacgagctcaagtctaaggacggtggggaatcattttggtgtttcttttgttcctctgtttccaggtgttgtccagaaacagaagatgtgcactggggtagactcgtcaagttgttggaagggactatctggtgttctctatactgcctctagctgggctgagatacatgcttttgtattggggtcatga

SEQ ID NO: 135 - protein, 614 aa, Nicotiana tomentosiformis
MRFSLLSPLVLNPVIRFSNSNALFGLRFQLYPRYSRYLRSPVTMASAKPKPAAAVNKFPVEEECVGIARKCWIKFKRESTFALYTPFVVSLASGTLNLDTFRHYIAQDVHFLKSFAQAYEAAEECTDDDDAKVGISELRKNVIEELKMHDAVLKEWGIDLVKESSLNPATAKYTDFLSATASGKVEGVKAAKLATPFERTKLAAYTLGAMTPCMRLYAYIGKELQVFLEGEKIHPYKKWIDSYASESFQASALQTEDLLDKLSVPLTGEELDIIEKLYHQAMKLEIDFFLTQPLVQKAVIPLSKDHNPAEHRLTIFSDFDLTCTVVDSSAILAEIAIITAPRSDQNRPENQIARMLSADLRNTWGDLSKQYTEEYEQCIEKMLLTEKAEKFDYERLHKTLEELSDFEKRANTRVTESGVLKGLNLEDIKRAGQRLILQDGCTNFFQSIIRNENLNADIHVLSYCWCGDLIRSSFSSGGIDALNVHANEFMFQESLSTGEIVKKVESPIDKVQAFSKIRMNCGNDQKNLTLYIGDSVGDLLCLLEADVGIVLGTSSSLRTVGNHFGVSFVPLFPGVVQKQKMCTGVDSSSCWKGLSGVLYTASSWAEIHAFVLGS

SEQ ID NO: 136 - DNA, 1779 bp, Populus trichocarpa
  CDS (1)..(1779): Populus trichocarpa gene encoding TMP phosphatase [XP_002325785.2]
atgcgcctactcttgtttacttctccaaacccaatcaaaacctcttcatcactatatttcctcaactcgctccgatccaacttaaccaaacgcaccttgccaactcggagatctttcatccctgcaagaatggcaatccctccacgatcaatagcatcagcgccatcttgcactacaacatcaggcagaagtaacatcaacattgaagagggtcttgctagtaaattctggatcaagtttagaagagaatccgtttttgctatgtacactccttttgtcatctctttggcttctggcactctcaagattgattctttcaggcattatatctctcaagattctcactttctcaaatcttttgctcatgcgtttgaattagcggaagagtgtgctgatgatgatgaagcaaagctagcaatctccgagttgaggaagggtgtcttagaggagctgaagatgcacaattcatttgtacaggaatggggtatagacccaggtaaagaggggactatcaattctgctactgtaaaatacacagatttcttgttggctacagcttctgggaaggttgaaggagtgaaaggtcttggtaaacttgcaactccttttgaaagaacaaaagttgcagcctatactctgggtgccatgacaccttgcatgcggctgtattcctttctaggcaaggaactccaggcagttttagatccggaggaagatgggcacccttacaagaagtggattgacagttattcgtctgagagttttcaggcatcagctctgcaaactgaagacttgctggataaacttagtgtctccttgacaggcgaggagcttgacatcattgaaaagctttatcaccaggccatgaaacttgaaatagaattcttccttgctcagccaattgctcagacaactttagctcccctgacaaaagggcataaccctgaagaagaccggcttgtcatattttctgattttgatttgacatgcactgttgttgactcttctgccattttggcagaaattgcaatactaacagcaccaaaatctgatgtggttcaacctgagactcaaattgctcgaatgtcatcagctgatctgaggaacacatggggtcttctttctggacagtacacggaagagtatgaacaatgtattgaaagcattatgccatctgcaaaagtggaattcaactatgaagctctttgtaaagcacttgaacaactttcagactttgagcgaagggcaaattctagagtgattgattctggagttctcaaaggtttgaatcttgaagatgtaaaacgagcgggtgaacgtttgattcttcaggatggttgcattggtttctttcagaaaattgtgaagaatgaaaatttgaacactaatgtccatgtgctctcatactgctggtgtggtgatctcatcagatcagctttctcctcagggggtttggatgctctaaatattcatgcaaatgagttaatttttgaagaatcaatctccacgggagagattaacttgactgtttacattggagattcagttggtgacttgctttgtctacttcaggcagatattggtattgtagttggatctagtgcaagcttaaggagcgtgggaagtcaatatggtgtttcttttgtaccactgttccctggcttggtaagaaaacagaaagaatctgatggagaatctcctaattggaaagggctatctggcatactatatacagtctccagttggtcagaaatacatgccttcattttggggtggtag

SEQ ID NO: 137 - protein, 592 aa, Populus trichocarpa
MRLLLFTSPNPIKTSSSLYFLNSLRSNLTKRTLPTRRSFIPARMAIPPRSIASAPSCTTTSGRSNINIEEGLASKFWIKFRRESVFAMYTPFVISLASGTLKIDSFRHYISQDSHFLKSFAHAFELAEECADDDEAKLAISELRKGVLEELKMHNSFVQEWGIDPGKEGTINSATVKYTDFLLATASGKVEGVKGLGKLATPFERTKVAAYTLGAMTPCMRLYSFLGKELQAVLDPEEDGHPYKKWIDSYSSESFQASALQTEDLLDKLSVSLTGEELDIIEKLYHQAMKLEIEFFLAQPIAQTTLAPLTKGHNPEEDRLVIFSDFDLTCTVVDSSAILAEIAILTAPKSDVVQPETQIARMSSADLRNTWGLLSGQYTEEYEQCIESIMPSAKVEFNYEALCKALEQLSDFERRANSRVIDSGVLKGLNLEDVKRAGERLILQDGCIGFFQKIVKNENLNTNVHVLSYCWCGDLIRSAFSSGGLDALNIHANELIFEESISTGEINLTVYIGDSVGDLLCLLQADIGIVVGSSASLRSVGSQYGVSFVPLFPGLVRKQKESDGESPNWKGLSGILYTVSSWSEIHAFILGW

SEQ ID NO: 138 - DNA, 1860 bp, Jatropha curcas
  CDS (1)..(1860): Jatropha curcas gene encoding TMP phosphatase [KDP23738.1]
atggcgatccctccaaagctagcttcctcatcgtcttccatggccgcctcccctacttctgctggtggaaccaacgaggaaggcctcgctagtaaattctggatcaagtttcgccgagaatcggttctcgctatgtacactcctttcgtcgtctcttttgccgccggcaacctcaagattgagagttttaggcattacatcgctcaggattttcacttcctcaaagccttcgctcacgcgtatgaattggcagaagagtgtgctgatgatgatgatgccaagctagctattgccgcgttgaggaagggggtcttagaggagctgaagttgcataaatcatttgtacaggaatggggtatggacccttccaaagaggtgactatcaattctgcaactgcaaaatacacagatttcttgttggctacagcttctggaaaggttgaaggagtgaaaggtcctggtaaacttgcaactccttttgaaagaacaaaagttgcagcttacactcttggtaccatgacaccctgtatgaggttgtatgcctttctagctaaggagctgcaagcactaatagatgcagaagctggtattcatccttaccagaagtggattgacaattactcatctgagagttttcaggcatcagctctgcaaactgaagacttgctggataaacttagtgtccctttgacaggcgaagagcttgacatcattgaaaagctttatcaccaagccatgaaacttgaaatagagttcttcaatgcgcagccacttgatcagcccactgtggttcctctgacaaaagagcataaccctctagaagatcgcctcgtgatattttctgattttgatttgacatgcacagttgttgattcctctgccattttggcagagattgcaattttaacagcatcaaaatctgatcagtcacaatctgataatcaaaatgctaggatgtcatcaactgagctaaggaacacatgggttcttctctctggacagtatactgaagaatatgagcaatgcattgaaagcattctgccctctgaaaaaatggagttcaactttgaagctttgtgtaaagcactcgaacaactctcagactttgagcgaagggcaaatgctagagttatcaaatctggagttcttaagggtttgaatcttgaagacataaaacgagctgtggagttcaactttgaagctttgtgtaaagcactcgaacaactctcagactttgagcgaagggcaaatgctagagttatcaaatctggagttcttaagggtttgaatcttgaagacataaaacgagctggtgaaagactgattcttcaagatggctgcaccagtttttttcagaaaatctcgaagaatgaaaatctgaatgctaatatacatttcctctcatattgttggtgtgctgatctgatcagatctgctttctcatcagggggtttggatgttctgaatatacatgcgaatgagtttgatttcgtagaatcaatttcaacgggtgagattattatgaaggtggaaacccctacagacaaagcccaagcttttaataatattttaatgaactacagccctgacaaaaagaatttgactgtttatattggagactcagttggggacttgctttgtctgcttgcggcagatataggcatcgtgatcggatcaagctccagcctaaggagagtcggaagtcagtttggtgtaacatttttaccattgtatcctggcttggttaaaaaacagagagagtatactgaaggaagctcttggaattggaagggtcaatctggcgttctgtacacagtttctagttgggctgaaatacattccttcgttttgggatggtag

SEQ ID NO: 139 - protein, 619 aa, Jatropha curcas
MAIPPKLASSSSSMAASPTSAGGTNEEGLASKFWIKFRRESVLAMYTPFVVSFAAGNLKIESFRHYIAQDFHFLKAFAHAYELAEECADDDDAKLAIAALRKGVLEELKLHKSFVQEWGMDPSKEVTINSATAKYTDFLLATASGKVEGVKGPGKLATPFERTKVAAYTLGTMTPCMRLYAFLAKELQALIDAEAGIHPYQKWIDNYSSESFQASALQTEDLLDKLSVPLTGEELDIIEKLYHQAMKLEIEFFNAQPLDQPTVVPLTKEHNPLEDRLVIFSDFDLTCTVVDSSAILAEIAILTASKSDQSQSDNQNARMSSTELRNTWVLLSGQYTEEYEQCIESILPSEKMEFNFEALCKALEQLSDFERRANARVIKSGVLKGLNLEDIKRAVEFNFEALCKALEQLSDFERRANARVIKSGVLKGLNLEDIKRAGERLILQDGCTSFFQKISKNENLNANIHFLSYCWCADLIRSAFSSGGLDVLNIHANEFDFVESISTGEIIMKVETPTDKAQAFNNILMNYSPDKKNLTVYIGDSVGDLLCLLAADIGIVIGSSSSLRRVGSQFGVTFLPLYPGLVKKQREYTEGSSWNWKGQSGVLYTVSSWAEIHSFVLGW

SEQ ID NO: 140 - DNA, 1842 bp, Citrus sinensis
  CDS (1)..(1842): Citrus sinensi gene encoding TMP phosphatase [XP_006484613.1]
atgcgcttccttttcacaaacccaatcaaaaccccattactctcttctattcttttccattgtcccaactcgccccgactcggccttcttgactcagtccgagtcaactcaccttcttctttgacaactcaaagatcgtcactttcgatggcggcgattcccccaaaatcgccgagccctgaggaggagggactcgcgaggaggttgtggatcaagtttaagagagaatctgtgtttgccatgtactccccgtttacggtttgtttggcttctgggaacctaaagcttgaaaccttcaggcattacatcgcccaagattttcattttctcaaagctttcgcccaagcgtatgaactggcggaagaatgtgctgatgatgatgatgcaaagttatctatctctgaattgaggaagggtgtacttgaggagttaaaaatgcatgattcctttgtgaaggagtggggtacagatcttgctaaaatggctactgttaactctgcaactgtaaagtatacagagttcttgttggcaacagcttccgggaaggtcgaaggtgttaaaggtcctggaaaacttgcaaccccatttgagaaaactaaagttgccgcttacacattgggtgccatgtcaccttgtatgaggctctatgctttccttggaaaggaattccatggcctcctaaatgctaatgaaggcaatcatccttacaagaagtggattgacaattattcttctgaaagttttcaggcctcagctctgcaaaatgaggacttgctggataaacttagtgtctctttgacaggcgaagaactagacataatagaaaagctctatcaccaagccatgaaacttgaagtagagttcttctgtgctcagccacttgctcagcccactgtagttcctctgattaaagggcataatcctgcaggagaccgtctaattatattttctgatttcgatttgacttgcaccattgttgattcctctgccattttggcagagatcgcaatagtgacagcaccaaaatctgaccagaatcaacctgaaaatcaacttggtcggatgtcatcaggtgagctgaggaacacatggggtcttctttccaaacagtacacagaggagtacgaacaatgcattgaaagcttcatgccctctgagaaagtggagaatttcaactatgaaactttgcataaagcacttgagcaactctcacactttgagaagagggcaaattctagagtgatcgaatctggagttctcaagggtataaatcttgaagatattaaaaaagctggtgaacgcctgagtcttcaagatggttgcactaccttctttcagaaagttgtaaagaatgaaaatttgaatgctaatgtccatgtgctttcatactgttggtgtggtgatctcatcagagcatctttttcttcagcaggtttaaatgcactgaatgtacatgcgaatgagttctcattcaaagaatctatttcaacgggtgaaattattgagaaagtggagtcccccattgacaaagttcaagctttcaacaatactttagagaaatacggaactgacagaaagaacttgagtgtttacattggagactctgtgggtgacttgctttgtctgcttgaggctgatataggcattgtaatcgggtctagctcaagcttaaggagagtgggatctcaatttggtgttacatttatcccgttgtaccctggcttggttaagaaacagaaggagtacactgaaggaagctcttctaactggaaggagaaatctggcatactttacacagtctcaagttgggctgaagtacatgcctttatcttggggtggtag

SEQ ID NO: 141 - protein, 613 aa, Citrus sinensis
MRFLFTNPIKTPLLSSILFHCPNSPRLGLLDSVRVNSPSSLTTQRSSLSMAAIPPKSPSPEEEGLARRLWIKFKRESVFAMYSPFTVCLASGNLKLETFRHYIAQDFHFLKAFAQAYELAEECADDDDAKLSISELRKGVLEELKMHDSFVKEWGTDLAKMATVNSATVKYTEFLLATASGKVEGVKGPGKLATPFEKTKVAAYTLGAMSPCMRLYAFLGKEFHGLLNANEGNHPYKKWIDNYSSESFQASALQNEDLLDKLSVSLTGEELDIIEKLYHQAMKLEVEFFCAQPLAQPTVVPLIKGHNPAGDRLIIFSDFDLTCTIVDSSAILAEIAIVTAPKSDQNQPENQLGRMSSGELRNTWGLLSKQYTEEYEQCIESFMPSEKVENFNYETLHKALEQLSHFEKRANSRVIESGVLKGINLEDIKKAGERLSLQDGCTTFFQKVVKNENLNANVHVLSYCWCGDLIRASFSSAGLNALNVHANEFSFKESISTGEIIEKVESPIDKVQAFNNTLEKYGTDRKNLSVYIGDSVGDLLCLLEADIGIVIGSSSSLRRVGSQFGVTFIPLYPGLVKKQKEYTEGSSSNWKEKSGILYTVSSWAEVHAFILGW

SEQ ID NO: 142 - DNA, 1728 bp, Prunus persica
  CDS (1)..(1728): Prunus persica gene encoding TMP phosphatase [XP_007199656.1]
atggcggcattggctcgtcatagcattgttagactcaatcacgaaggaggcctagccagacggctgtggttcaagttcagagacgactctgttttctctctctacactcccttcttcgttggcttagcctctgctactctgcactctgaaactacctttcgccatttcatctctcaggacctccattttctcaaagccttcgttctcgcatatgaattggcggaagattgtgctgatgatgaggacgacaagaatggtttacgcgatttgagaaaacgtgccgtcggcaggcttcaaatgcacgacacatttgtccgagaatggggttttgaattcccaaatgaggacatttctaaagacattgcaacaaccaaatacacagatttcttgcttgcaacagcatcagggaaaattgaaggagaaagatcggttctggacaaaatcgcaacccctttcgaaaagaccaaggttgctgcatatacacttgctgctctggctccttgtatgagactctatgccttcatcagtactgagatccaaggcattataaatcctgatcaagatagcactcacatttacaaaagctggatagaaaattattcgtctcaagttttcgaggaaatagccctgcaaaatgaagacatgctagataaacttagtgtttctttgactggtgaggagcttgagattatagagaagctctatcatcaagctatgaagcttcaagtagattttattgctgctcaaccaatttctgatcagcaatctgtagttcctttgtctcgggtgcatgactttagcaaacgccatcttacgatactttgtgactttgatttggcatgcactgcttttgattctgctgccatattggctgagattgcgatcataacagcaccaaaggctgatatggatggatctgatcaaacccaacttgctcggatgccatcagcagacttaaggagcacatgggatgttctttcaacccaatacactgaacaatttgaacaatgtgtagaaagcattgtggccagtgagagagtggaagaattcgattatgaacgtctgtgtagcgcgcttgaacaacttgcggagtttgagagaaaggcaaatgaaagggtggttcagtcaggagtgttgaagggtttaaatgcggaggatataaaaagggctggacagagcctcattctgcaagatggttgcagaagcttctttcagaagattgtgaaaaataaaaatctgaaaactgatgttcatgtgctttcatactgctggtgtaatgacctcattgtatcagctttctcttcaggagatttgaatgtcttgaatgtacattcaaatgagttggtttatcaagaatctgtcacaactggtgaaattgtaaagaagatggagtctcccatggaaaagcttcaagtcttcaacgacgtcctaatcgaccgcaggggcgaaggcaataaacacttgacagtttacattggaggctcagtgggtgacttgctttgcctgcttgaagcagatataggcattgtagttggttcaagttcaagcctaaggagactaggtgatcattttggtgtttcctttgtcccattgttctctggcttggtgaagaggcagaaagaacttgctgatcaagattgtgcctctaattggtggaaaccattgtctggtgttctttatacggtgtctagttgggctgaaatacaggcattcattttgggtacatag

SEQ ID NO: 143 - protein, 575 aa, Prunus persica
MAALARHSIVRLNHEGGLARRLWFKFRDDSVFSLYTPFFVGLASATLHSETTFRHFISQDLHFLKAFVLAYELAEDCADDEDDKNGLRDLRKRAVGRLQMHDTFVREWGFEFPNEDISKDIATTKYTDFLLATASGKIEGERSVLDKIATPFEKTKVAAYTLAALAPCMRLYAFISTEIQGIINPDQDSTHIYKSWIENYSSQVFEEIALQNEDMLDKLSVSLTGEELEIIEKLYHQAMKLQVDFIAAQPISDQQSVVPLSRVHDFSKRHLTILCDFDLACTAFDSAAILAEIAIITAPKADMDGSDQTQLARMPSADLRSTWDVLSTQYTEQFEQCVESIVASERVEEFDYERLCSALEQLAEFERKANERVVQSGVLKGLNAEDIKRAGQSLILQDGCRSFFQKIVKNKNLKTDVHVLSYCWCNDLIVSAFSSGDLNVLNVHSNELVYQESVTTGEIVKKMESPMEKLQVFNDVLIDRRGEGNKHLTVYIGGSVGDLLCLLEADIGIVVGSSSSLRRLGDHFGVSFVPLFSGLVKRQKELADQDCASNWWKPLSGVLYTVSSWAEIQAFILGT

SEQ ID NO: 144 - DNA, 1944 bp, Phoenix dactylifera
  CDS (1)..(1944): Phoenix_dactylifera gene encoding TMP phosphatase [XP_008796407]
atgcgattcctctcccctcttctccccctccgccgaaacccaaaccctagccctaggttcttctcgctctcccctcccatatccctcgcctccgcctgcccccgattcggtttcttgaatcgagatcgcccccggcgccgccttccaaaggggttccgatcgatcgccgcggcgaatcagcgggcgtcgcctccaagattggtgccggagagggcggccgccacgagttcttggccttcttcagccggacgagccatggcagtggtggcgacggcggttgaagaaggctccgcggcgaagcggttctggatcaggtcccggaaggaggcggtgttcgcggagtacaccccgttcgtggtgtgcctggcggcggggagactggagatggaggccttccgcgactacattgctcaggacgtgcacttcctcaatacttttgcccaagcgtatgagatggcggaagagtgtgctgatgatgatgatgcgaaggctgcaataactgatctgaggaaagctgttttggaggaactgaaaatgcatagttcatttgtccaagaatggggaatagaccccactaaagaaatcattcctttccctgcaacagtaaagtacaccgacttcctgcttgctacagctgcaggaaaagttgaaggagggaaagatcctgggaaaattgtcactccttttgagaagacaaaaattgctgcttatactgtaggtgccatggctccttgcatgaggctttatgcattcttgggaaaagagctccagacgtgtctgcaacttgacgaaaattgtcatccctacaaaaagtggattgataattattcctctgaaagttttgagacagctgctgtgcaaatagaagaattgcttgacaaattgagtgtttcattgactggggaggagcttgaagacatagaaaagctttaccgccaagctatgaaacttgaaattgaattttttcttgctcagccaattgtccgaccagctgtagttcctttgacaagactgcatgatccggcaaattgccttgtcattttttctgattttgacttgacatgcagtgtagttgattcctctgccattttagcagagattgcaatattaagtgcaccaaagactgataagactgggactgataatttagatgctcgaaggtcttcttcagaaatgagaaactcatgggatgctctttctaaacagtatacagaagagtatgagcagtgcatagaaagcttacttccattagaagaagctaaaacatttgattatgaaggcctttgcaaaagtttgggccagctctctgagtttgagaaacgagcaaattccagggttattgagtctggggtgctaaagggaatgaatctagatgacataaaaagagctggggaacgtttgatcctccaagatggttgtatagatttttttcagaaggttgtaaaggaaaaggaaaatctaaatttagatctccatgtactttcttattgttggtgtgcggatctaataaggtcagctttttcatcagtaggttgcctaaatgatttgaacatacactcaaatgagttcaactatcaagaatctatttcaacgggtgaaattgttaggaagatggaatcacccatggacaaggttgaagcattcaaaagtatcttaagcaaccttggaagcaatgagaagcgcttatctgtgtacattggagattcggttggtgacttgctttgcctgttggaagcagatgttggtattgtgattggatcaagcactagcttaaggagaatcgggaagcagtttggtgtttctttcattccactcttccgtggtttggtaaacaagcaaagacaacttaatgaaaaagactcatctatctggaaggggttgtctggtgttctttatacagcatcaagctggtcagaaatacaagcttttattttgggggcataa

SEQ ID NO: 145 - protein, 647 aa, Phoenix dactylifera
MRFLSPLLPLRRNPNPSPRFFSLSPPISLASACPRFGFLNRDRPRRRLPKGFRSIAAANQRASPPRLVPERAAATSSWPSSAGRAMAVVATAVEEGSAAKRFWIRSRKEAVFAEYTPFVVCLAAGRLEMEAFRDYIAQDVHFLNTFAQAYEMAEECADDDDAKAAITDLRKAVLEELKMHSSFVQEWGIDPTKEIIPFPATVKYTDFLLATAAGKVEGGKDPGKIVTPFEKTKIAAYTVGAMAPCMRLYAFLGKELQTCLQLDENCHPYKKWIDNYSSESFETAAVQIEELLDKLSVSLTGEELEDIEKLYRQAMKLEIEFFLAQPIVRPAVVPLTRLHDPANCLVIFSDFDLTCSVVDSSAILAEIAILSAPKTDKTGTDNLDARRSSSEMRNSWDALSKQYTEEYEQCIESLLPLEEAKTFDYEGLCKSLGQLSEFEKRANSRVIESGVLKGMNLDDIKRAGERLILQDGCIDFFQKVVKEKENLNLDLHVLSYCWCADLIRSAFSSVGCLNDLNIHSNEFNYQESISTGEIVRKMESPMDKVEAFKSILSNLGSNEKRLSVYIGDSVGDLLCLLEADVGIVIGSSTSLRRIGKQFGVSFIPLFRGLVNKQRQLNEKDSSIWKGLSGVLYTASSWSEIQAFILGA

SEQ ID NO: 146 - DNA, 1860 bp, Zea mays
  CDS (1)..(1860): Zea mays gene encoding TMP phosphatase [XP_008678418.1]
atgcttgttctccgccgtctccgcctccgcctcccactgccacgccctcttctcgtctcctccttctcctccacctccccctcctcctcaccctcgacctctagctcctcctcctgttggtcgtcgacaggcgaaagtagaagggccatggcgtcatctccttctcccgattcggccgcggtcgttgccgagggctccgcggctcgccgcttctggatcgctgcctccacgcgcgaggccgccttcgccgcatacacgcccttcctcctctccctcgccgccggcaatctgcggctcaacgtgtttcgccactacatcgcgcaggacgcgcacttccttcacgccttcgctcgcgcgtacgaaatggccgaggactgcgctgatgatgacgacgacatggccaccatagccgccctcaggaaggccatcctccaagagctcaacctccactcctccgttctgaaggagtggggagttgatcctaccaaagagatacctccaagtgcagctacaaccaaatatactgatttcctacttgcaactgcggctggaaaagttgatggcacaaaaggttctgacaaaatggttactccatttgagaagactaaaattgctgcatacactgttggggccatgactccatgcatgaggctttatgcatatctaggcaaagaactcatggttttccttaaacaagatgaaaatcatccatacaagaaatggattaacacatatgcatccagtgattttgaggacaccacactccaaatagaagaattgctagacaaactaagtgtctcattaactggtgaggaacttgagattattggcaagctctaccagcaagctatgaaactggaagtggagttcttttcttctcagcttatagaccaacctgttgtagctccactttcaagatactgtgatccaaaatataaactcttgatcttttctgattttgatttgacgtgcactattgttgattcatctgccattttggcggagattgcaattttgtcattccaaaaggcaaatcaaagtgggattgataataacctcgaccgtgcaaaatcgggagacctgagaagttcgtggaacatgctctctaagcaatacatggaagagtatgagaaatgcatggaaagactacttcctccagaagaatcgaagtcactagattatgataaactgtataaaggcctggaggtgctagctgagtttgagaagcttgcaaattctagggttgtcgactctggtgtgctgaggggaatgaatttggaagacatcaggaaagctggtgagcgtcttattcttcaaggtggctgtaaaaatttctttcagaagattgtaaaaacaagggagaacctcaatttggatgtccatattctttcctattgctggtgtgcagaacttataagatcagccttctcatcagccggttgtctagatggtttgaacatacattcaaatgagtttgcctttgaggattctgtttcaactggtgagatcgacagaaagatgcagtctccgctagacaaagttgaaaagttcaagagcatcagaagtgacgtggacagtacagtgccattcctatctgtttatattggagactcggttggagatttgctctgcttattggaggctgatattggtatagtcattgggtcaaccacaagtttgcgtagggtgggcaaacagtttggtgtttcttttgtcccattgttccctggtctagtagagaagcagaggcaactggcggaggaagatgcatccgtattcaaggcacggtctggagtcctctatacggtttctagctggtcagaaatacacgccttcgtactgggaagtgatttcagctga

SEQ ID NO: 147 - protein, 619 aa, Zea mays
MLVLRRLRLRLPLPRPLLVSSFSSTSPSSSPSTSSSSSCWSSTGESRRAMASSPSPDSAAVVAEGSAARRFWIAASTREAAFAAYTPFLLSLAAGNLRLNVFRHYIAQDAHFLHAFARAYEMAEDCADDDDDMATIAALRKAILQELNLHSSVLKEWGVDPTKEIPPSAATTKYTDFLLATAAGKVDGTKGSDKMVTPFEKTKIAAYTVGAMTPCMRLYAYLGKELMVFLKQDENHPYKKWINTYASSDFEDTTLQIEELLDKLSVSLTGEELEIIGKLYQQAMKLEVEFFSSQLIDQPVVAPLSRYCDPKYKLLIFSDFDLTCTIVDSSAILAEIAILSFQKANQSGIDNNLDRAKSGDLRSSWNMLSKQYMEEYEKCMERLLPPEESKSLDYDKLYKGLEVLAEFEKLANSRVVDSGVLRGMNLEDIRKAGERLILQGGCKNFFQKIVKTRENLNLDVHILSYCWCAELIRSAFSSAGCLDGLNIHSNEFAFEDSVSTGEIDRKMQSPLDKVEKFKSIRSDVDSTVPFLSVYIGDSVGDLLCLLEADIGIVIGSTTSLRRVGKQFGVSFVPLFPGLVEKQRQLAEEDASVFKARSGVLYTVSSWSEIHAFVLGSDFS

SEQ ID NO: 148 - DNA, 1830 bp, Oryza sativa
  CDS (1)..(1830): Oryza sativa gene encoding TMP phosphatase [NP_001062539.1]
atgcgcggcctcctccgccgtgtctacctccgcctcccccctttccctcctgccacctctctttattattggtcaagaacaagacctgcagctgcagggcccaaccaccccatccctaggcgcatgtcgacgtcctctactgccgcggcggtcgttgccgagggctccgccgctcgccgcttctggatcgccgccgcctcgagggaggccgccttcgccgcctacacgcccttcctcgtctccctcgccgccggggccctccgcctggattccttccgccaatacatcgcccaggatgcctacttcctccacgccttcgcccgcgcctatgagatggccgaggagtgcgccgatgacgacgacgacaaggccaccatcgtcgtcctcaggaaggccatcctccgcgagctcaacctccacgcttccgtccttcaggaatggggagtcgatcccaacaaagaaatccctccaatcccagccacaactaagtacactgatttcttacttgcaacttccactggaaaggttgatggtgggaaaggttctgataaaatggtcacaccattcgagaagacgaaaattgctgcatacactgttggggctatgaccccatgcatgaggctttatgcgtatctgggcaaagaacttgcagttttcttgaaacaggatgaaaatcacccatacaagaaatggattgagacttatgcatccagtgattttgagaataacgcactccaaatagaagagttgcttgataaactaagtgtctctctaactggcgaggagcttgagattattgggaagctctaccagcaagctatgaggctggaagttgagttcttctctgctcagccagtagaccaacctgttgtagctccactctcaagatattgtggtccgaaagataagctcttgatattttgtgattttgatttgacatgcactgttgttgattcatctgccattttggcggagattgcaatcttgtcacaccaaaaggctagtcaaggtggggctgatagttcccttgatcgtacaaaatcagcggacttgagaaattcatggaacatgctctcaaatcaatacatggaagagtatgagcaatgcatagcaagcttgcttcctccagaagaagcaaggtcactagactatgatcaactgtataaaggtttggaggtgctatcgcagtttgagaaacttgcaaactctagggtggttgattctggtgtcctgaggggaatgaatttagatgacatccgaaaagctggagagaggcttattctgcaagatggatgcaaaattttttttcaaaagattggcaaaacaagggagaacctcaatttagatgtccatattctttcctattgctggtgcgcagatcttataaggtcagctttttcatcagttggttgtctagacgggctgaacatacattcaaatgagtttgcttttgagggatctgtttcaactggtcatattaacagacaaatggagtctcctctggacaaagctgaaaagttcaagagcatcaaaagcgacgtgggtagtacagggacattattgtcagtctatattggggactcggttggagatttgctttgcttgttggaggcagatattggtattgttgttggatcaagcacaaccttgcggagagtgggcaaacagtttggtgtttcatttgttcctctgttcactgggttggtagagaagcagaggcgaatagaaaaggaagaatcatccatcttcaaggcacggtctggaattctttatacggtttctagctggtcggaggtacaggctttcatcctgggaaatgatttcagctga

SEQ ID NO: 149 - protein, 609 aa, Oryza sativa
MRGLLRRVYLRLPPFPPATSLYYWSRTRPAAAGPNHPIPRRMSTSSTAAAVVAEGSAARRFWIAAASREAAFAAYTPFLVSLAAGALRLDSFRQYIAQDAYFLHAFARAYEMAEECADDDDDKATIVVLRKAILRELNLHASVLQEWGVDPNKEIPPIPATTKYTDFLLATSTGKVDGGKGSDKMVTPFEKTKIAAYTVGAMTPCMRLYAYLGKELAVFLKQDENHPYKKWIETYASSDFENNALQIEELLDKLSVSLTGEELEIIGKLYQQAMRLEVEFFSAQPVDQPVVAPLSRYCGPKDKLLIFCDFDLTCTVVDSSAILAEIAILSHQKASQGGADSSLDRTKSADLRNSWNMLSNQYMEEYEQCIASLLPPEEARSLDYDQLYKGLEVLSQFEKLANSRVVDSGVLRGMNLDDIRKAGERLILQDGCKIFFQKIGKTRENLNLDVHILSYCWCADLIRSAFSSVGCLDGLNIHSNEFAFEGSVSTGHINRQMESPLDKAEKFKSIKSDVGSTGTLLSVYIGDSVGDLLCLLEADIGIVVGSSTTLRRVGKQFGVSFVPLFTGLVEKQRRIEKEESSIFKARSGILYTVSSWSEVQAFILGNDFS

SEQ ID NO: 150 - DNA, 1683 bp, Picea sitchensis
  CDS (1)..(1683): Picea_sitchensis gene encoding TMP phosphatase [ABR16455]
atgggggtcgccgatgaagcaggagtcgccagaaggctatggacaaagttcaagaaagacaccgcgcttgcacagtataattcctttgttgttgctttggcggccgggacgctcaacatgacgtcttttcagcagtacatggcgcaggatgcttattttctcaaagcatttgctcaggcgtacacaatggcagaggattgcgcagatgatgacgacgacaaagcatcgatccgtgaactacgaaaagccgctgaggaagagctcaatctgcacaattccttggctgaggactgggacgttgaatttgcaaaagagtgctctcccaatatggcaacagtcaagtacacagaatttttattggcaacagctgctggcaaggtggaaggagggaagggaccaagcagaagtgtgactccttttgagaaaacaaaaatagcagcatacacagtgggtgccatgaccccgtgcatgaggctttatgctttcttgggccaagaaattgtcaaagccctggaacctgattgcagtaatcatccatataagcagtggattgaaacatactcttctgcaaagtttgaggcatcggcattacaaactgaagagttgcttgacaaactggctatttcgctaactggggaagagcttgaagtgctgcggaggttgtattatcatgccttaaaactagaaatagaattcttttccgctcagcctttctctcagagaacattagttccgatgttgaaactgggtgattcagccagccgccgatataccattgtctcagatttcgatttgtcttgcactgtcttggattcttcagcagtattagcagaaattgcaatattgactactctcaaaactgagcaaaatggtgctgaaaacttaagtgatcacaagtcatcatcggagttgagaaaaacttgggatgcactttctagtcaatattctgaagaatgtgaagaatgcttaaggaagactctgccacctgaagaagtgggctcttttgattatgaaggcctacaccaatctcttgagcatctgtctcagtttgaaatggaggcaaactctaaagttgtcgagtcaggtgtccttgagggcattaatatagatgacattaaaaaggcaggagagcgtcttgcatttcaggatggatgcgcaaacttttttgaacaaatcctaacgaaaatggacagcttaaatgtggatgtgcacataatttctgtttgttggagtggagatatcatcagggctgctttttcatcaagcggtttggatggtttacaggttcattcaaatgaactcacctttgtggaatcagtctctactggtggtattgataggcgtgttgagtccccagttgacaagttgaaaatcttcaataatatttggagttcttcaaaggaccaggacacggaacatatctctatatacattggggacggtttaggtgacttgctttgtcttcttcaggcagatattggaatagtgattggtacaagctcaacgctaagaagggttggaaaacgttttggagtatcctttgttcctttgttttctggtcttctcaaacaggagagagcatatgtagaaggttctagttgttggacaaaacaaagtggtattctttataccgtctctagttggagtgaaatacatgcttttattttgggctcttccaattga

SEQ ID NO: 151 - protein, 560 aa, Picea sitchensis
MGVADEAGVARRLWTKFKKDTALAQYNSFVVALAAGTLNMTSFQQYMAQDAYFLKAFAQAYTMAEDCADDDDDKASIRELRKAAEEELNLHNSLAEDWDVEFAKECSPNMATVKYTEFLLATAAGKVEGGKGPSRSVTPFEKTKIAAYTVGAMTPCMRLYAFLGQEIVKALEPDCSNHPYKQWIETYSSAKFEASALQTEELLDKLAISLTGEELEVLRRLYYHALKLEIEFFSAQPFSQRTLVPMLKLGDSASRRYTIVSDFDLSCTVLDSSAVLAEIAILTTLKTEQNGAENLSDHKSSSELRKTWDALSSQYSEECEECLRKTLPPEEVGSFDYEGLHQSLEHLSQFEMEANSKVVESGVLEGINIDDIKKAGERLAFQDGCANFFEQILTKMDSLNVDVHIISVCWSGDIIRAAFSSSGLDGLQVHSNELTFVESVSTGGIDRRVESPVDKLKIFNNIWSSSKDQDTEHISIYIGDGLGDLLCLLQADIGIVIGTSSTLRRVGKRFGVSFVPLFSGLLKQERAYVEGSSCWTKQSGILYTVSSWSEIHAFILGSSN

SEQ ID NO: 152 - DNA, 1641 bp, Physcomitrella patens
  CDS (1)..(1641): Physcomitrella patens gene encoding TMP phosphatase [XP_001769831]
atgaatttgagcacgcaagctaacacagggttggcgaagagcttctgggctagttgtaagagagaggcttatgcatcactctaccatccgtttgtggttgcgttagcggctggcaccttgccaaaacaaacttttcaacgttacatggcacaggatgcctatttcttggaggcgttcaagaatgcgtatcaactggctatggaaaccactacagacgaagaggcaaaggccatcattgagtcccttcagagagatgtgcaggaagagctcaatttgcactcgtcgatcatgcagtctttggatgctaccgatcagaattgctttgaaccaaacatggcaacaacagcgtattgtgattttctgctagccacagctacaggaagtaacgaagcacaaaaatttggaagcacaagtgctcaaatcataaccgctatgactccttgcatgcggctatatgcatttttggggcaggagctcaaaaaacacgttgatcatgttgctgaccatccttaccaggagtggattgatacttactctgctgcagagttcgaggctgcagcttcgaagattgagcagctgctagacaagttaactgctactttgactggaaagcatgaaatagcattcttagaaagtctctatcttcaagccatgaacttggaggtggatttcttcggtgctcagctgttagggcctgtgctcgtacccttcctcaaatgccaaccggctccagagagctatatattacttgcgtctgactttgattccacgtgcacgatatctgattcatgccccatattggcagacctgaccgtgcaaactgcgcgaaaatctcacggtggtcgttcagttggtgaatcaggggccagcttgttgaaaaaaagatgggatgatctcgtcatgcagtatatggacgagtatgaggacgttctgaagcgaagcctggtgaaaaaagataatggcagtgttaatgcgctcagtgcagagaatctccaagagtttctgaaggaaatgtccaacttcgaacagaaggccaatgcgagggtcgaagaggctgcagttctaaaaggcttatctctggcttcgattcaagaagctggaaaatccatgcctcttcgtgagggctgttctgacttttttaagcgtctggaatcaggagaggttcttgttgacacatgtatattgtctgtgtgctggagcaaaaccttcatcgaagctgtcttggaaaaggttcgtattccaaacatcaatgccaacgagctcgttttcgaaggacgcatttccaccggtgctattatcaaaaacgtcgaaacggctcttgacaagcaaagacacttcgttcagttgctggataatctaaaaccaactcaagacgtgctgtccatttatgttggtgatagtctgactgatcttctctgcctaatcagagcagacctgggtatagttctcggtgacagcagcgctctgaagcaggtgtatgggccaaaaatggcccccctcttcatgaaagccatactcttggagcaggcaaacatgcgaggcaggcagcaacccacaggttacgtcttcactgtctccagttggtatgaggtggaagcctttctgttgggtcctgctagaaacagacctttgtacatctag

SEQ ID NO: 153 - protein, 546 aa, Physcomitrella patens
MNLSTQANTGLAKSFWASCKREAYASLYHPFVVALAAGTLPKQTFQRYMAQDAYFLEAFKNAYQLAMETTTDEEAKAIIESLQRDVQEELNLHSSIMQSLDATDQNCFEPNMATTAYCDFLLATATGSNEAQKFGSTSAQIITAMTPCMRLYAFLGQELKKHVDHVADHPYQEWIDTYSAAEFEAAASKIEQLLDKLTATLTGKHEIAFLESLYLQAMNLEVDFFGAQLLGPVLVPFLKCQPAPESYILLASDFDSTCTISDSCPILADLTVQTARKSHGGRSVGESGASLLKKRWDDLVMQYMDEYEDVLKRSLVKKDNGSVNALSAENLQEFLKEMSNFEQKANARVEEAAVLKGLSLASIQEAGKSMPLREGCSDFFKRLESGEVLVDTCILSVCWSKTFIEAVLEKVRIPNINANELVFEGRISTGAIIKNVETALDKQRHFVQLLDNLKPTQDVLSIYVGDSLTDLLCLIRADLGIVLGDSSALKQVYGPKMAPLFMKAILLEQANMRGRQQPTGYVFTVSSWYEVEAFLLGPARNRPLYI

SEQ ID NO: 154 - DNA, 1593 bp, Selaginella moellendorffii
  CDS (1)..(1593): Selaginella_moellendorffii gene encoding TMP phosphatase [XP_002990363]
atgtcgtgtttgcttagaaatgtagtggccagaggattgaggagcttggcaagcgcccaggcgatggagccatccatttcaaagcgcttgtggcagcaatccaagcgcgaggcaatggtatgtctgtatcatccatttgtggtgtccatcgctgctgggacgctggatcttcacagcttccagcgattcatagcgcaggattccttcttcctgacggcattcgcgaaagcctatggtttggccatagagcgcagcgatgatcgagaagttaaatctgagatttgcaagctccaacaggctgtgtacgaggaacttgagctccattcttccctcatgaaggcttggaacttcgatcatacaccaccatcgccagcaacttgtgcttacacagattttctcctcgcagtggctgctgggaagaaaattgaatgcgagaaaactaaggtgccgatgctcgctctggcagcaatggctccgtgcatgcgtctctacgctttcctaggccaagagacgagagttttctctcgagaaaatcatccatatcgcgactggatttcgacttactcgtcgcctggtttcgagactgctgctactcgactcgagcagcttctcgatagcctctcggaagctcaagagactacggcagcggaatttcagagtatgcaaagtttgtatcaccgtgccatagcgtacgaggtgagcttcttcgatgcccaggaagtgcgtggcagcaacgcttttgtcccgctgctagagagtgtagcactcaaggatcgcaacttcgtcctcatctctgattttgattctacttgcaccgtctctgattcatccccagttctagcggagctggctatggcggtcgatccaaatgtaaggaggaaatggagcagcctctcggacgagtatttcagggactactccaaactcctggaagaagttgttcttcgtgagtacgactacgatgcgatcaaagaggctctccaagttctttccgagtttgagaagcaagggaacgcgaaaatcgacgcctcccgcgttttgcaaggcattaagatcgatgatatcaagcaagccggacaaaacatggcacttcaagctggctgtgccagtgtgctttgcaggctaagttccaaaatctcttgtcaaatcctctcggtttgctggagccggaccttcatcgaagcagctttctccaaagagaatatcaccaatgttcctgtccattccaacgaactcgaaaacgatgggaactttacaaccgggagcttgatcagacgcgtcgagacaccgattgacaaggaagagacgatgtttcgtgagattctacacgctccggacgacaagtttgtgattttcattggagacagcctcacggatctgctagccttgctccgagctgacattggaattgttctaggaacgagctccagcctcgatcgagcctccaaagcctttggagtgaagatcgtgccactcttttccggcctcgtccagcggcagcaaagctctcgatcagcgtggagaaaagaggaaggagttttgtatcgagcttctggatggctggagatagaagcgtttctagctggtaattag

SEQ ID NO: 155 - protein, 530 aa, Selaginella moellendorffii
MSCLLRNVVARGLRSLASAQAMEPSISKRLWQQSKREAMVCLYHPFVVSIAAGTLDLHSFQRFIAQDSFFLTAFAKAYGLAIERSDDREVKSEICKLQQAVYEELELHSSLMKAWNFDHTPPSPATCAYTDFLLAVAAGKKIECEKTKVPMLALAAMAPCMRLYAFLGQETRVFSRENHPYRDWISTYSSPGFETAATRLEQLLDSLSEAQETTAAEFQSMQSLYHRAIAYEVSFFDAQEVRGSNAFVPLLESVALKDRNFVLISDFDSTCTVSDSSPVLAELAMAVDPNVRRKWSSLSDEYFRDYSKLLEEVVLREYDYDAIKEALQVLSEFEKQGNAKIDASRVLQGIKIDDIKQAGQNMALQAGCASVLCRLSSKISCQILSVCWSRTFIEAAFSKENITNVPVHSNELENDGNFTTGSLIRRVETPIDKEETMFREILHAPDDKFVIFIGDSLTDLLALLRADIGIVLGTSSSLDRASKAFGVKIVPLFSGLVQRQQSSRSAWRKEEGVLYRASGWLEIEAFLAGN

SEQ ID NO: 156 - DNA, 648 bp, Anaerotruncus colihominis
  CDS (1)..(648): Anaerotruncus colihominis gene encoding TMP phosphatase [WP_006874980]
atgatcaaaggcgcgatttttgatatggacggtacgctgattgattccatgcctctatgggaggactgcggacgggcctttttatccgcgcgcggcattactgcgcgtgacgatctgggcgaaacgctcaaatccctgtcgatggagcaaacggctaattatttgcgggacgcatacggtatttccgagacaacctctgaaatcattgagatgatcaatggaatggttactgacgcatatcagcgcaccatcccgcttaaacgtgacattgccgcgtttctcgagcgcctcaggcaggcggatgtgcgcatgtgtgtcgcaacggcaacggaccgtccactggtggaggcggcgcttggacgccttgacctcctgcccttttttgaacggattttcacctgttcggaggtgggggccggcaaggaccgccccgatatctttgagcaggcgtgcgccgcgcttggcacgccgcgcggcgaaaccgtcatctttgaggatgctctttatgcgattgaaacagctcggcgcgccgggttccgcgttgtcgcaatcgcggacgacgcctccgccggcgacgaggcgcgcatagccgcactgtctgagcaatatatacataactatgaggaatgcgaggtaaacagtttatga

SEQ ID NO: 157 - protein, 215 aa, Anaerotruncus colihominis
MIKGAIFDMDGTLIDSMPLWEDCGRAFLSARGITARDDLGETLKSLSMEQTANYLRDAYGISETTSEIIEMINGMVTDAYQRTIPLKRDIAAFLERLRQADVRMCVATATDRPLVEAALGRLDLLPFFERIFTCSEVGAGKDRPDIFEQACAALGTPRGETVIFEDALYAIETARRAGFRVVAIADDASAGDEARIAALSEQYIHNYEECEVNSL

SEQ ID NO: 158 - DNA, 666 bp, Eubacterium ventriosum
  CDS (1)..(666): Eubacterium ventriosum gene encoding TMP phosphatase [WP_005362972]
atgtcaacaggatttatatttgatgtagatggaacaatactagactcaatgggaatatggatgaacgtaggagaactatatctaaaagatatgggaataaaggcggaaccaaatcttggagaaattctattcgaaatgacaatgaatgaaggtgcagaatacatacaaaaaaagtataatctaaaccttacaacagaagaaatatgcaccggaataaacaaccgtgtatacaaattctacgaaaaagaagcaatgccaaaaccaaaagttatcgactttatagaacaagcctacgagaacaaaatcccaatgacaatagcaacgtcaacagacagaccaatgatagaagcagctttcaaaagactgcacatagacaaatattttaaaaaaatatttaccacgacagaggttgggtatggaaaagacaaaccggacatcttcataaaagcaatggaagaaatgggaacaacaccaaagcaaacatggctatttgaagatggagcatactcaatagaaacagccaaacaactaggcataaaaacaataggaatctacgatcctgcaagcgaaaaagaccaggaaaaaataagaaacctaacaaacatctacataaaaaattggacagaacacaaaaccctacttaaccaaatacaaaacaacaagtag

SEQ ID NO: 159 - protein, 221 aa, Eubacterium ventriosum
MSTGFIFDVDGTILDSMGIWMNVGELYLKDMGIKAEPNLGEILFEMTMNEGAEYIQKKYNLNLTTEEICTGINNRVYKFYEKEAMPKPKVIDFIEQAYENKIPMTIATSTDRPMIEAAFKRLHIDKYFKKIFTTTEVGYGKDKPDIFIKAMEEMGTTPKQTWLFEDGAYSIETAKQLGIKTIGIYDPASEKDQEKIRNLTNIYIKNWTEHKTLLNQIQNNK

SEQ ID NO: 160 - DNA, 1482 bp, Coprococcus eutactus
  CDS (1)..(1482): Coprococcus eutactus ATCC 27759 gene encoding TMP phosphatase [EDP27707]
atgaaaaagatagttatcagcgatataaaaggtgcgatatttgacatggatggagttctgctggactctatgccgatgtgggaccatgcgggcgagatgtaccttgcaggacaggggatagaggctgagcctgatcttgaaaaagtcttgtttacaatgactatgcaaaagggcgctgaatatatacgtgatcattatgggttaaaactcacggcggatgagatcatagatggcataaatgagactgtgagagatttctatgcaaataaggttgtgcctaagaatggagtccttaagttcctcaggctgttgaagagtcacaatatacctgtaaccgttgcaacttcgaccgacagatgccatgtggaggctgctctttcaagaaatggacttatggaatatgtagacaagatatttacgtgttcggaagttggcgttggaaaggctgcctctccaaagatatatgagcttgcggccgaatttatggggacgaaagtcggcgagtcatttgtgttcgaggatgcctatcatgcggccgagacagctcagaatgcgggatttacagttgtaggactctatgacgagtcaagccgtgacatgcaagcagaacttaaggttcactgcaattattactatttgggatttgccgagcttatagatgagctgctgcctgacagaagccagcttgcaccggttcttaccatcgcgggcagtgattcatcgggaggtgcgggaatacaggcagatcttaagaccatgcaggcaaatggagtgtttggcatgagcgcagtaactgccttgacggcgcagaataccacaggtgtgacatccatcatgaatgtgacacctgacatacttgcagatcagatagatgcagtatttacagatataagaccacaggcggtcaagataggtatggtgtctgtgccagaacttataaatgtgatcgcagacaagcttgaattttacagggcggagaatgtggtgcttgatcctgtgatggttgcgacaagcggtgctaaactcataagcgatgatgctgtggacgttttgacaggaaggctgttcccacttgcaaagctgatcaccccaaatattccagagacagaggccctcacaggtatgagtatccggtctaaggaagatatggaaagtgcagcaaggaaaatatatgaaaaatatggctgctcagttcttgtgaagggcggacatagcataaacgatgcgaatgatatgctgtttgatggagagaatgtatcatggttttcaggtgagagaatagaaaatccgaatacccatggaacggggtgtacactctcaagtgcaatagcctccaaccttgcaaagggatatgatatagaaacttctgtgcagagagcaaaagcgtacatctcaggagccctggctgcgatgcttgatctaggaagaggaagcggcccgttaaaccatggctttgatatagacagcagattcatgatataa

SEQ ID NO: 161 - protein, 493 aa, Coprococcus eutactus
MKKIVISDIKGAIFDMDGVLLDSMPMWDHAGEMYLAGQGIEAEPDLEKVLFTMTMQKGAEYIRDHYGLKLTADEIIDGINETVRDFYANKVVPKNGVLKFLRLLKSHNIPVTVATSTDRCHVEAALSRNGLMEYVDKIFTCSEVGVGKAASPKIYELAAEFMGTKVGESFVFEDAYHAAETAQNAGFTVVGLYDESSRDMQAELKVHCNYYYLGFAELIDELLPDRSQLAPVLTIAGSDSSGGAGIQADLKTMQANGVFGMSAVTALTAQNTTGVTSIMNVTPDILADQIDAVFTDIRPQAVKIGMVSVPELINVIADKLEFYRAENVVLDPVMVATSGAKLISDDAVDVLTGRLFPLAKLITPNIPETEALTGMSIRSKEDMESAARKIYEKYGCSVLVKGGHSINDANDMLFDGENVSWFSGERIENPNTHGTGCTLSSAIASNLAKGYDIETSVQRAKAYISGALAAMLDLGRGSGPLNHGFDIDSRFMI

SEQ ID NO: 162 - DNA, 663 bp, Ruminococcus bromii
  CDS (1)..(663): Ruminococcus bromii L2-63 gene encoding TMP phosphatase [CBL14666]
atgattaaatctgcaatatttgatgttgacggcacacttctcgattcaatgaagatatgggatgatgcaggagagcgttacctctcgtctgtcggcaaaacagccgaaaacggactttccgaaaagctctgtgatatgagtctgacggagggtgcggagtatatgaaaaagcagtatgctctttccttttcaactgatgaaatagtttcgggtgtgctgaaaatcattgaagatttttacttttatgaggtcggtttaaaaaacgatgcaaaagaaattttgcagtttttggaatcgaacaatatcaaaatgattattgcaacatcaagcgacaaaacgcatattaaaaaggcatttgaaaggctcggtattctaaaatattttacggatattgtgacctgttcacaagtcggaaaaggcaaaacaagccccgacatttaccttgtctgtgcagataaactcggaacagctccgagtgaaacgcttgtattcgaggacgctgtttttgccgcagaaactgctcacaaggcaggtttcaaaacggtgggagtgtatgacgaattgagcaggaataataaaaacagaataaaagccgtttgcgattactacgcagacagctttgaaaaagcggcagattgggggcaccaccttttgtcgctgtaa

SEQ ID NO: 163 - protein, 220 aa, Ruminococcus bromii
MIKSAIFDVDGTLLDSMKIWDDAGERYLSSVGKTAENGLSEKLCDMSLTEGAEYMKKQYALSFSTDEIVSGVLKIIEDFYFYEVGLKNDAKEILQFLESNNIKMIIATSSDKTHIKKAFERLGILKYFTDIVTCSQVGKGKTSPDIYLVCADKLGTAPSETLVFEDAVFAAETAHKAGFKTVGVYDELSRNNKNRIKAVCDYYADSFEKAADWGHHLLSL

SEQ ID NO: 164 - DNA, 1434 bp, Dorea longicatena
  CDS (1)..(1434): Dorea longicatena DSM13814 gene encoding TMP phosphatase [EDM62146]
atgataaaaggagcaatatttgatgtagacggaacccttctggattccatggagatctgggaagacgtaggagtccgttatctgaacagtatcggtatagaggcagagccggatcttgggacggtgttatttacaatgagcatccaggaaggtgcagcatatgtaaaagaacattatcatctgtcccaggagccggaagaaattgtgcagggagttctggacatcatcagcaattattataagaaaaccgcactattaaagagtggagtgaaggaacttctggaaaagcttgataagcataatatcccaatgacggttgcatcatccaataataaaaaagagatagagatggcatttgagcgtctgggaattgcaaaatattttgaccggatctttacctgtgaagaggtcggtgcgggaaagacgaagccggatatttatctgcgggcagcagaatatctcggaacccgtccggaggagacggttgtattcgaagatgtcattcatgcaatccgtactgcaaagcaggcagggttccaggttgtaggaatctatgatgaagcaagtaaggatgaccaggaagaggttcagagagaagtagactggtattgtagagagtgggcagaacttatgaaaaaaaagacagcaattacaatcgccggaagtgattcaagtggaggtgcaggaattcaggcagacatcaagacgatgcaggcaaacggagtctacgcaatgagtgcaatcaccgcactgacagcccagaatacaaccggagtaaccggaatcatggaagtatctccggaatttctagaacaacagttggacgcagttatcacagacatccgtccggatgcagtgaaaatcggtatggtgtcatcagaagagttaataaaaatgatatcaaagaaactaaaagagtaccatctggagaatatcgtagttgatccagtgatggtagcaacaagcggatccagactgatcagtgaaaccgcgattgatacattaaaaacacagctgctgccaatggcaactgtgatcacaccgaatatcccagaggcagaagttcttgcagaaatggagattagatcagaagatgatatggtggaagcagcaaagaagattcatgaaatgtatcactgtgcagtcttatgcaaaggcggacacagcctgaatgatgcgaatgatctcctataccaggatggagaaacaacatggttccacggaaaaagaatcaacaacccgaacactcacggaaccggctgtaccttatccagcgcaatcgcatccaatctggcaaaaggatattctctggaagaatctattcaccgcgcgaaagagtatatcagcggggcgttggaagccatgttagatctgggaaaaggaagcggaccgatggatcatgggtttgagatgcgggggagattttctatttaa

SEQ ID NO: 165 - protein, 477 aa, Dorea longicatena
MIKGAIFDVDGTLLDSMEIWEDVGVRYLNSIGIEAEPDLGTVLFTMSIQEGAAYVKEHYHLSQEPEEIVQGVLDIISNYYKKTALLKSGVKELLEKLDKHNIPMTVASSNNKKEIEMAFERLGIAKYFDRIFTCEEVGAGKTKPDIYLRAAEYLGTRPEETVVFEDVIHAIRTAKQAGFQVVGIYDEASKDDQEEVQREVDWYCREWAELMKKKTAITIAGSDSSGGAGIQADIKTMQANGVYAMSAITALTAQNTTGVTGIMEVSPEFLEQQLDAVITDIRPDAVKIGMVSSEELIKMISKKLKEYHLENIVVDPVMVATSGSRLISETAIDTLKTQLLPMATVITPNIPEAEVLAEMEIRSEDDMVEAAKKIHEMYHCAVLCKGGHSLNDANDLLYQDGETTWFHGKRINNPNTHGTGCTLSSAIASNLAKGYSLEESIHRAKEYISGALEAMLDLGKGSGPMDHGFEMRGRFSI

SEQ ID NO: 166 - DNA, 1305 bp, Lachnospiraceae bacterium
  CDS (1)..(1305): Lachnospiraceae_bacterium_3_1_57FAA_CT1 gene encoding TMP phosphatase [EPC05128]
atgaaatgtgacagaaagacaatgcttctttatgcggtgaccgatcgggcctggacaggagaaaagacactgcttatgcaggtcgaggaagcgctggcaggaggtgtgacctgtgtccagcttcgtgaaaaggatatgccaaaggagcagttcctggaagaagcggagagtataaaaagactttgtcataaatatgggatcccttttataattgacgatgatgtggagctggccgtacgctgcggcgcggacggggtgcatgtgggacagcatgatatggaggcaggcgcggtccgccggaaaatcggagacggcatgctgctgggcgtatcagtccagactgtggaacaggcagtggaagccgaaaaaaagggagcggattaccttggtgtgggcgctgtgttttccacttccacgaaaacggacgcacaggaggtttccctggataccctccgggaaatctgccgggcggtgtccgtacccgtctgtgcaatcggagggatacacaaaggaaatatgcatttgctgcaggatacgggaatcgatggggtggctttggtgtcggccatcttttccagtccctgcatacagaaggaatgcagggagctgcgggtcctggcagagagactgaaaaggaaaggggctatttttgatgcggacggaaccctgctggattccatgtccgtttgggatactctgggtgaaaaatatctgcggaaaaagggtattgttccggaaaagaacatcagggaaacaataaaaaatatgagtcttcctcaggctgcggtctattttcagactgcttatgggattgcggatgcagaagacaagattatagaggatattaatggaatagcggcgtccttttacatcaatgaggtgaagctgaaggaaggcgtgaaaacggttctggacaagctgaagcagaaaaacgtaaagatgtgtgtggcgacggctacggacaaagggctgattgaaaaggcacttgagagaaacggaatcagagattattttgaggctgtcctcacctgcacggatgtgggcgcgggaaaggatgagccggttatcttccgtaaggccgggcagcttctcggaacagcaaaagaggataccattgtaattgaagatgccttgtatgctgttaagacagcgaaagaggacggtttcctggtggcggctgtttatgatccgtcagcagaaaaggaggaaccggagatccgggagatctctgacttctatttccggtcatttaatgaaatggagagttatctgaatgaaaaaagttcttacgatagcgggctctga

SEQ ID NO: 167 - protein, 434 aa, Lachnospiraceae bacterium
MKCDRKTMLLYAVTDRAWTGEKTLLMQVEEALAGGVTCVQLREKDMPKEQFLEEAESIKRLCHKYGIPFIIDDDVELAVRCGADGVHVGQHDMEAGAVRRKIGDGMLLGVSVQTVEQAVEAEKKGADYLGVGAVFSTSTKTDAQEVSLDTLREICRAVSVPVCAIGGIHKGNMHLLQDTGIDGVALVSAIFSSPCIQKECRELRVLAERLKRKGAIFDADGTLLDSMSVWDTLGEKYLRKKGIVPEKNIRETIKNMSLPQAAVYFQTAYGIADAEDKIIEDINGIAASFYINEVKLKEGVKTVLDKLKQKNVKMCVATATDKGLIEKALERNGIRDYFEAVLTCTDVGAGKDEPVIFRKAGQLLGTAKEDTIVIEDALYAVKTAKEDGFLVAAVYDPSAEKEEPEIREISDFYFRSFNEMESYLNEKSSYDSGL

SEQ ID NO: 168 - DNA, 1305 bp, Fusicatenibacter
  CDS (1)..(1305): Fusicatenibacter  gene encoding TMP phosphatase [CUQ30753]
atgaaatgtaacagaaagacaatgcttctttatgcggtgaccgaccgggcctggacaggagaaaagacactgcttacgcaggtcgaggaagcgctggcaggaggtgtaacctgtgtccagcttcgtgaaaaggatatgccaaaggagcagttcctggaagaagcggagagtataaaaagactttgccataaatatggtgtcccttttataattgacgatgatgtggagctggccgtacgctgcggtgcggacggggtacatgtgggacagcatgatatggaggcaggcgcggtccgccggaaaatcggagacggcatgctgctgggcgtatcagtccagactgtggaacaggcagtggaagccgagaaaaagggagcggattaccttggtgtgggcgctgtgttttccacttccacgaaaacggacgcacaggaggtttccctggataccctccgggaaatctgccgggcggtgtccgtacccgtctgtgcaatcggagggatacacaaaggaaatatgcatttgctgcaggatacgggaatcgatggggtggctttggtgtcggccatcttttccagtccctgcatacagaaggaatgcagggagctgcgggccctggcagagaggctgaaaaggaaaggggctatttttgatgcggacggaaccctgctggattccatgtctgtttgggataccctgggtgaaaaatatctgcggaaaaagggtattgttccggaaaagaacatcagggaaacaataaaaaatatgagtcttcctcaggccgcggtctattttcaaactgcttatgggatcacggatgcagaagacaagattatagaggatattaatggaatagcggcgtccttttacatcaatgaggtgaagctgaaggaaggcgtgaaaacggttctggacaagctgaagcagaaaaacgtaaagatgtgtgtggcgacggctacggacaaggggctgattgaaaaggcacttgagagaaacggaatcagagattattttgaggctgtcctcacctgcacggatgtgggcgcgggaaaggatgagccggttatcttccgtaaggccgggcagcttctcggaaccgcaaaagaggataccattgtaattgaagatgccttgtatgctgttaagacagcgaaagaggacggtttcctggtggcggctgtttatgatccgtcagcagaaaaggaggaaccggagatccgggagatctctgacttctatttccggtcatttaatgaaatggagagttatctgaatgaaaaaagttcttacgatagcgggctctga

SEQ ID NO: 169 - protein, 434 aa, Fusicatenibacter
MKCNRKTMLLYAVTDRAWTGEKTLLTQVEEALAGGVTCVQLREKDMPKEQFLEEAESIKRLCHKYGVPFIIDDDVELAVRCGADGVHVGQHDMEAGAVRRKIGDGMLLGVSVQTVEQAVEAEKKGADYLGVGAVFSTSTKTDAQEVSLDTLREICRAVSVPVCAIGGIHKGNMHLLQDTGIDGVALVSAIFSSPCIQKECRELRALAERLKRKGAIFDADGTLLDSMSVWDTLGEKYLRKKGIVPEKNIRETIKNMSLPQAAVYFQTAYGITDAEDKIIEDINGIAASFYINEVKLKEGVKTVLDKLKQKNVKMCVATATDKGLIEKALERNGIRDYFEAVLTCTDVGAGKDEPVIFRKAGQLLGTAKEDTIVIEDALYAVKTAKEDGFLVAAVYDPSAEKEEPEIREISDFYFRSFNEMESYLNEKSSYDSGL

SEQ ID NO: 170 - DNA, 1296 bp, Clostridium species
  CDS (1)..(1296): Clostridium sp KLE1755 gene encoding TMP phosphatase [ERI68966]:
atgaaatgtgacagaagcatgctgctcctctatgccgtaaccgaccgtgcctggacgggtaaaaaaacactgctgcagcaggtggaggaagccctggcaggcggcgccacctgcatccagcttcgggaaaaggagctgccggaggaagaattccggcaggaagccctggctgtgaaagaactttgccgcagataccatgtccctttcctcattaacgacaacgtagagctggctgtcagctgcggcgcggacggcgtccatgtgggccagcacgacatgtctgcggcggatgtgcgccgcagaatcggccccggcaaaatactgggagtatccgcgcagacggtggagcaggcccgccaggcggaagaagacggcgcagattatctgggcgtgggcgctgttttttccacctccaccaaatccgacgcagacgcggtatcccatgagaccctgcaaaagatctgcgccgcagtatccatccccgtctgcgccataggcggcatccataaagaaaatctgcatttgctcaaaggcacaggcatcgccggcgtggcccttgtttccgccatcttcgcaagcccggatatccgtaagtcctgcgaagacctgaaaaaactggccctgcagataaacgcgcaggacacactggaagcactgctgcatacaaacatccgcggagccatctttgacgcggacggcacccttttagactccatgggcatctgggatactctgggggaagattacctgcgtacaaaagggaaaatcccccgggaaaacctgcgtgaaaccttccgcgacatgagccttctccaggccgcctgctattaccgggaaaattacgcccttacggaaagccctgaaaaaatagtggaagagcttaacgccatgatcgcctccttctatgaaaaagaagcccccctgaaggaaggagccgccgccttcctggaagcgctttgccaaagaaacataaaaatgtgcattgcaacagccaccgatcacagccttatccgggccgccctgaagcgatgcggagtgctgcattactttacttttatacttacctgcggacaagcaggagcgggaaaagacacccccgccatttatgaagaagccctggccctgcttggaaccggaaaaaaagaaaccttcgtttttgaagatgccctgtacgccctgaaaacggcgaaaacagccggctttcctacagtcggtgtaaaagacccctcctccgccggacaggaaggggagattataaaacaagccgattactatctttataccttcacgaaatga

SEQ ID NO: 171 - protein, 431 aa, Clostridium species
MKCDRSMLLLYAVTDRAWTGKKTLLQQVEEALAGGATCIQLREKELPEEEFRQEALAVKELCRRYHVPFLINDNVELAVSCGADGVHVGQHDMSAADVRRRIGPGKILGVSAQTVEQARQAEEDGADYLGVGAVFSTSTKSDADAVSHETLQKICAAVSIPVCAIGGIHKENLHLLKGTGIAGVALVSAIFASPDIRKSCEDLKKLALQINAQDTLEALLHTNIRGAIFDADGTLLDSMGIWDTLGEDYLRTKGKIPRENLRETFRDMSLLQAACYYRENYALTESPEKIVEELNAMIASFYEKEAPLKEGAAAFLEALCQRNIKMCIATATDHSLIRAALKRCGVLHYFTFILTCGQAGAGKDTPAIYEEALALLGTGKKETFVFEDALYALKTAKTAGFPTVGVKDPSSAGQEGEIIKQADYYLYTFTK

SEQ ID NO: 172 - DNA, 1452 bp, Eubacterium hallii
  CDS (1)..(1452): Eubacterium hallii gene encoding TMP phosphatase [EEG35494]
atgataaaaggagcaatctttgatattgatggaactttacttgattccatgcccatctgggaaaatgcaggagcgagatatcttgctactcttggcattaaggcaaagccagatttaaaagaacggctggatgctttatctttgccagaaggagccatctatatgcaaaaagagtatggcctttcggtatcagcagaagacattttagaaggagtcaatcaggttgtaaaagatttttactataaagaagcggtcatgaagccgggagcctatgccttagtaaaacgtctgaaagaaaatggtgtgaagttaattatagccacagcgacagataaggagatggcaaaggcggcgcttattcgtaacggcatatggcaggactttacgggaatgattacctgcgaggaagccggagccggaaagacaagcccgaaggtatttgagcttgcaaggcaaaagctaggcactaaaaaagaggaaacatgggtatttgaagattctttatatgcggtgaaaactgctactgaagctggatttccagtatgcagtatctacgatacctacagtgtgggaaatgcgaaagaaatccagaaactttctaatatttatgtgagagatttttcggagataggtgattattctttttcaaatatgaaaacagttcttacaattgcaggcagtgattcgagcggaggagcaggtattcaagcggatatcaagactttaactgttcataaagtatatgccatgacttgtatcaccgcacttaccgcacaaaatacagtcggaattaccgggattatgccagtaccagcagaattttttaaaaaacagatggaaagcattttcacagatataaagccagatgcggtgaaaattggaatgattgcttcaaaggaacaggcagagattatcgcagaatacctggaaaaatattctatcaaaaatgtagtggcagacccggtgatgatttcgacaagcggtacggttttagtagaagaaacaacgagaaagatattatatgagaaattatatccaaaagtttccctgctaaccccgaacattccagaaaccgaatttttatccgggataaaaattaccgataaaaaaacaagggaagaagcagcaaaagtcattgcagacaggtggaattgtgcggtcttaagtaagggcggtcacagcgaagaaaatgcggacgatttgctttatgagagttttttgcaggaagaaaaaaaagaaaaagccgtttggtttccagaagaaagaattgataatccaaacacacacggaaccggctgtacactttcaagtgcggtagcggcaaatctggcaaagggatttcctgtagaagaatccgtaaaaaaggcaaaagtatacatcagcggagcaattagagcaatgctgaatcttggacagggaaatggcccgctaaatcatatgtgggatttgtaa

SEQ ID NO: 173 - protein, 483 aa, Eubacterium hallii
MIKGAIFDIDGTLLDSMPIWENAGARYLATLGIKAKPDLKERLDALSLPEGAIYMQKEYGLSVSAEDILEGVNQVVKDFYYKEAVMKPGAYALVKRLKENGVKLIIATATDKEMAKAALIRNGIWQDFTGMITCEEAGAGKTSPKVFELARQKLGTKKEETWVFEDSLYAVKTATEAGFPVCSIYDTYSVGNAKEIQKLSNIYVRDFSEIGDYSFSNMKTVLTIAGSDSSGGAGIQADIKTLTVHKVYAMTCITALTAQNTVGITGIMPVPAEFFKKQMESIFTDIKPDAVKIGMIASKEQAEIIAEYLEKYSIKNVVADPVMISTSGTVLVEETTRKILYEKLYPKVSLLTPNIPETEFLSGIKITDKKTREEAAKVIADRWNCAVLSKGGHSEENADDLLYESFLQEEKKEKAVWFPEERIDNPNTHGTGCTLSSAVAANLAKGFPVEESVKKAKVYISGAIRAMLNLGQGNGPLNHMWDL

SEQ ID NO: 174 - DNA, 1362 bp, Eubacterium species
  CDS (1)..(1362): Eubacterium sp. CAG:252 gene encoding TMP phosphatase [CDB67556]
atgaaaaataaatttttcacacgcgagatttgtgtctgcgtgcacttgacacaaactcgttatgcgcaaaaaacgtgcgcagaaatgaggaatagtgtgaaggttaaagctgaggatatgcagctatacgctgttacagatacacagtggcttaatggacgtgactttcttgaagtaatagaaagcgttcttgcaaatggagctacatttttacagttaagggaaaaaaatgccacacatgaggaaatagtggcaaaggcgaaggcaataaagccaatagctaagaagtacggagtgccttttgtcatagatgatgacatatatgcagctaaagaggcagacgtggatggtgtccacatagggcagaatgatgcaagctatgagaaggcaagagaagttcttggagaaggcaagataataggaatgacggtcaagacaaggcagcaggcagaaaatgccataagacttggcgctgactatgttggaatgggggcagtgtttcatacaagcactaaaaaagatgcaaaggatatgagcagggaaacacttttagagcttgcagggatgatggaggatattccggtggtcgccattggcggcataagctatgataactgcgattacttaaaggacacaggtgttgatggaatagcagttgtttcagccatatttgcaagtgatgactgtgcgcttgccacaagaaagctttttgtaaagacaagggaattgtttggaaagaaaagaaacataataatggatatggatggtacgcttgcagactctatgcctttctggaaaaacagcgcaagagagtatgcgatattacgtggagcagatattccggataatttcgatgagataactggcgttatggaccttaatgattatgctgagtatgttaaaaatgttcttggcatagatactaatcttgagcagataacagaagcggctgtcgagattatgaataaacattacgaaaaagatatacctgcaaaggacggtatgacagagcttgtcacgagagaatataaggccggaagcagacttgttgtgtttacggcttcagatagaagaagtgttgaaattcttctttcacaccttggaataagagaatgtttttatgatatatatacagtctatgatgtaggacttaagaagagtgataagaacagctatcttaaggtggcagagcttgcaggcatgaaagatacatcacaggtatgggtatatgaggatatattaagaggtgtaaaggcagcgaaagaggccggacttaatgtgtgtgcagtgtatgatgaggactccgcaggcgactgggaggacataaaagagcttgcggataagacccttgaacttgtgtaa

SEQ ID NO: 175 - protein, 453 aa, Eubacterium species
MKNKFFTREICVCVHLTQTRYAQKTCAEMRNSVKVKAEDMQLYAVTDTQWLNGRDFLEVIESVLANGATFLQLREKNATHEEIVAKAKAIKPIAKKYGVPFVIDDDIYAAKEADVDGVHIGQNDASYEKAREVLGEGKIIGMTVKTRQQAENAIRLGADYVGMGAVFHTSTKKDAKDMSRETLLELAGMMEDIPVVAIGGISYDNCDYLKDTGVDGIAVVSAIFASDDCALATRKLFVKTRELFGKKRNIIMDMDGTLADSMPFWKNSAREYAILRGADIPDNFDEITGVMDLNDYAEYVKNVLGIDTNLEQITEAAVEIMNKHYEKDIPAKDGMTELVTREYKAGSRLVVFTASDRRSVEILLSHLGIRECFYDIYTVYDVGLKKSDKNSYLKVAELAGMKDTSQVWVYEDILRGVKAAKEAGLNVCAVYDEDSAGDWEDIKELADKTLELV

SEQ ID NO: 176 - DNA, 1260 bp, Lachnospiraceae pectinoschiza
  CDS (1)..(1260): Lachnospiraceae pectinoschiza gene encoding TMP phosphatase [CUQ76318]
atgaaagttacccgtgaagatatgcagctttacgccgttacagatacgcaatggcttaatggcagggatttctatgaagagattgagaaagtccttgcggcaggagctacatttttgcagttaagagaaaaggattcgacacacgaggagattgtaaaaaaagcattggcaattaaaccgatagcaagaagatatggtgtgccatttgttatagatgatgatatatacgcggcgttagaggcagatgttgacggagttcatataggacaaagtgatgcaagctacgaaacagcaagagagcttctaggacctgacaagataataggaatgacagtaaagacaccagagcaggcggcaaatgcggcaagacttggtgctgattatgttggaatgggagctgtatttcatacaagcacgaagaaagatgccaaagatttaagcagggataatcttcttaagcttacagctatgcttgatatgccgatagttgcaattggcggcattaattatgacaactgtgattatttaaaagatacaggcgtggacggaattgctgttgtatcggcgatatttgcaagtgatgactgcgcggaggcgacacgaaagctttataagaagacaagaaagctgtttaattataataagaacataatatttgatatggacggaacacttgttgactctatgccgttctggaagaatagtgcaagggaatatgccattttaagaggtgctaagcttccaaagaattttgatgagataacaggagttatggacctttcggaatatgcggcttatctgcaaaatgttcttgggattgatacatcgctagaacagataacagaggcagcagttgatattatgaataagcattatgcaagtgatattcctgcaaagaagggaatgataaagcttataagaagagaatatgaggctggaagcaagcttgtaatattcagtgcttccgatacttccagtgtggaaattcttcttaaaaggttagaaatatatgaatgttttgagggaatatacacagtatatgatgtcggcataggaaagagtgataaggaaagctataaaaaggttgccaggtcagcaggaatggatatatctgatacgtgggtgtatgaggatattctaagaggcgttcgggcggcacataatgctggattgaaagtgtgtgcggtatatgataaagactcggcagatgactgggatgagatatgcagtattgcagataaatgtataataaccggataa

SEQ ID NO: 177 - protein, 419 aa, Lachnospiraceae pectinoschiza
MKVTREDMQLYAVTDTQWLNGRDFYEEIEKVLAAGATFLQLREKDSTHEEIVKKALAIKPIARRYGVPFVIDDDIYAALEADVDGVHIGQSDASYETARELLGPDKIIGMTVKTPEQAANAARLGADYVGMGAVFHTSTKKDAKDLSRDNLLKLTAMLDMPIVAIGGINYDNCDYLKDTGVDGIAVVSAIFASDDCAEATRKLYKKTRKLFNYNKNIIFDMDGTLVDSMPFWKNSAREYAILRGAKLPKNFDEITGVMDLSEYAAYLQNVLGIDTSLEQITEAAVDIMNKHYASDIPAKKGMIKLIRREYEAGSKLVIFSASDTSSVEILLKRLEIYECFEGIYTVYDVGIGKSDKESYKKVARSAGMDISDTWVYEDILRGVRAAHNAGLKVCAVYDKDSADDWDEICSIADKCIITG

SEQ ID NO: 178 - DNA, 1296 bp, Peptostreptococcaceae bacterium
  CDS (1)..(1296): Peptostreptococcaceae bacterium OBRC8 gene encoding TMP phosphatase[WP_009530263]
atgaaaaatattgactatacaatgtattacgtcaccgatgaagaccttttgagcagtaatcataccttggaaacatctgtacaagatgccattttaggtggctgtacaatgatacagcttcgagaaaaacattcatccactctcgatttttataacaaagccataaaaattaaagccatttgcgacaagtacaacatacctcttataataaatgacagaatagatgtagctcttgcaataaacgcagacggagtacatctcggacaagacgatatgcctcttgatattgcaagaaaaattatgggagatggcaaaattataggaatatcaactgcaactttagatgaagctctaatcgctcaacaaggcggtgcagattatgtaggagtaggtgctatgtacagcacaaacacaaaaaccgatgccaatttgacaactataaacgagcttacaaaaataaaaaacaatctaaaaatacctgtagttgcaatcggcggtataaaccttgacacaatacctgctctaaaacctgcacaaatagacggagttgcaatagtatccgctatatctatgcaggaagataccgtatctgcaacaagaaaattaaaaaatacttttttgaaacaatatcaaactaaaggcgtaatattcgatattgacggtactctgcttgaaactatgaacatatgggacaatgtacttctaaaccttatgaatacacttaatatcagctataccgaagatgaaatacaaaaaatatggaatatgggttttgcagagcttgcacagttcagcataaaaaaattcaagcttgatatgagtgtaaaagaattttggcaacttataaaaaaattatcagtcgaagagtataaaaatagcaaaatacacttaaaaaaaggtgcaaaaaaactgcttgagtatctcaaagaaaaaggtgtaaaattagccatagcaactgccctttgcaaagaacagtatgaaatagtgcttacaaagacaggtatcatagactattttgacataatagcatcaagcgtagatttaaaaatggaaaaatcagacagacaaatatttgactatatagcaaaaaatctacaagttccaaacaaaaatcttattttctttgaagacgacataaactcgtcaacaggtgccaagttggcaggactaaaactgtgcattgtatcaaacaagaaatataacggtaacagcaaatttgacgctctcatagattataaaatagatgattttgaaaataaattgatatatgatgaaataatagtggagaaaaattag

SEQ ID NO: 179 - protein, 431 aa, Peptostreptococcaceae bacterium
MKNIDYTMYYVTDEDLLSSNHTLETSVQDAILGGCTMIQLREKHSSTLDFYNKAIKIKAICDKYNIPLIINDRIDVALAINADGVHLGQDDMPLDIARKIMGDGKIIGISTATLDEALIAQQGGADYVGVGAMYSTNTKTDANLTTINELTKIKNNLKIPVVAIGGINLDTIPALKPAQIDGVAIVSAISMQEDTVSATRKLKNTFLKQYQTKGVIFDIDGTLLETMNIWDNVLLNLMNTLNISYTEDEIQKIWNMGFAELAQFSIKKFKLDMSVKEFWQLIKKLSVEEYKNSKIHLKKGAKKLLEYLKEKGVKLAIATALCKEQYEIVLTKTGIIDYFDIIASSVDLKMEKSDRQIFDYIAKNLQVPNKNLIFFEDDINSSTGAKLAGLKLCIVSNKKYNGNSKFDALIDYKIDDFENKLIYDEIIVEKN

SEQ ID NO: 180 - DNA, 1296 bp, Peptostreptococcaceae bacterium
  CDS (1)..(1296): Peptostreptococcaceae bacterium CM2 gene encoding TMP phosphatase[WP_009527854]
atgaaaaatattgactatacaatgtattacgtcaccgatgaagaccttttgagcagtaatcacaccttggaaacatctgtgcaagatgccattttaggtggctgtacaatgatacagcttcgagaaaaacattcatccactctcgatttttataacaaagccgtaaaaattaaagctatttgcgacaagtacaacatacctcttataataaatgacagaatagacgtagctcttgcaataaatgcagacggagtacatctcggacaagacgatatgcctcttgatattgcaagaaaaattatgggagatggcaaaattataggaatatcaacctcaactttagatgaagctctaatcgctcaacaaggcggtgcagattatgtaggtgtaggtgctatgtacagcacaaacacaaaaactgatgccaatttgacaactatagacgagcttacaaaaataaaaaacaatttaaaaatacctgttgttgcaatcggcggtataaaccttgacactatacccgctctaaaacctgcgcaaatagacggagttgcaatagtatccgctatatctatgcaggaagataccgtatctgcaacaagaaaattaaaaaatacttttttgaaacaatatcaaactaaaggcgtaatattcgatattgacggtactctgcttgaaactatgaacatatgggacaatgtacttctaaatcttatgaatacgcttaatatccgctataccgaagatgaaatacaaaagatatggaatatgggttttgcagagcttgcacagttcagcataaaaaaattcaagcttgatatgagtgtaaaagaattttggcaacttataaaaaaattatcagtcgaagagtataaaaatagcaaaatacacttaaaaaaaggtgcaaaaaaactgcttgagtatctcaaagaaaaaggtgtaaaattagccatagcaactgccctttgcaaagaacagtatgaaatagtgcttacaaagacaggtatcatagactattttgacataatagcatcaagcgtagatttaaaaatggaaaaatcagatagacaaatatttgactatatagcaaaaaatctacaagttccaaacaaaaattttattttctttgaagacgacataaactcgtcaacaggtgcaaaacgtgcaggagtaaaactgtgcattgtatcaaacaagaaatataatggtaacagcaaatttgacgctctcatagattataaaatagatgattttgaaaataaattgatatatgatgaaataatagtggagaaaaattag

SEQ ID NO: 181 - protein, 431 aa, Peptostreptococcaceae bacterium
MKNIDYTMYYVTDEDLLSSNHTLETSVQDAILGGCTMIQLREKHSSTLDFYNKAVKIKAICDKYNIPLIINDRIDVALAINADGVHLGQDDMPLDIARKIMGDGKIIGISTSTLDEALIAQQGGADYVGVGAMYSTNTKTDANLTTIDELTKIKNNLKIPVVAIGGINLDTIPALKPAQIDGVAIVSAISMQEDTVSATRKLKNTFLKQYQTKGVIFDIDGTLLETMNIWDNVLLNLMNTLNIRYTEDEIQKIWNMGFAELAQFSIKKFKLDMSVKEFWQLIKKLSVEEYKNSKIHLKKGAKKLLEYLKEKGVKLAIATALCKEQYEIVLTKTGIIDYFDIIASSVDLKMEKSDRQIFDYIAKNLQVPNKNFIFFEDDINSSTGAKRAGVKLCIVSNKKYNGNSKFDALIDYKIDDFENKLIYDEIIVEKN

SEQ ID NO: 182 - DNA, 1365 bp, Atopobium species
  CDS (1)..(1365): Atopobium sp. ICM42b gene encoding TMP phosphatase [WP_035427744]
atgcaggtgaccggtgcaatttttgattgcgatggaactcttgttgattcaatgcgcgtttggcataacgtttttggcgctgttcttcctaaatatggcaagactattgattcggatatttttgaccgcgtagaggctgtttccctcattggtggatgtcagatttgcgttgatgaactggatttgcctattacagcggaagctttgtatgaagagttctgcgcgtacgtaattgatcagtaccaacatcatgtttcaatcattcccggtgcaaaggagttcttacaggagctctacgatgcaggtattcctatggccgttgcttcgtcaactcccgtgcgagaagttcgtgcagctctggcagctcaaggtattgagcacctcttcaaaacagtggtctcaacagaagatgtggggggagtggacaaggttgagcctgatgtttatcttgaggctcttcgccgtcttggcaccgataaggcaactacctgggtcttcgaggatgccccgtttggcgcacagacagcacaaaatgcgggctttcctgtggtagcgctctacaatgatcatgacggccgcgaccccgtctttatgcgcgagcactctaacatctttgcccacacctacggcgagctgtcgcttctgcgccttcaggactacgagcgccctctgaccgcagcgccttctggcgagaaaccccttgaggtccttgttgtgggcggatccccagaggcggtttcacacacgacgctgtctacctgcgcccaaagcgctgactacctgatagcggttgaccatggtgcagatgcatgtcacgctgccggcgtgattccacagcttgcgcttggagactttgactcggctacaccagaaactctggcttggctcaaagagcagcaggtaccttgcatgaagtttaatgcggacaagtacgataccgacctggctcttgctttaaagtccgccgagtacgaggctattcgtagagatagcaagctctctcttacggttgtctccacatctggcggacaccttgatcaccagcttgtagtgcttggtcttctcgccacgtgggcaaagacgggcaaggcaagtgttcgagttattgaaaatgactttgagatgcgctttttaactgcaggccaggttgattcttggcagctgagcgcaactgatgtaggtaaaaagatgtcccttgtggctttgtcagaggagtgcgaggtttctgaggccggcatgaagtggaatcttgatcaccagaagttcaccttgctgggagacgacggtatttcaaatatcgtcgaatcagacaattcctgggtaaggtgcgagaagggctgtcttttggtgcagctttggaactaa

SEQ ID NO: 183 - protein, 454 aa, Atopobium species
MQVTGAIFDCDGTLVDSMRVWHNVFGAVLPKYGKTIDSDIFDRVEAVSLIGGCQICVDELDLPITAEALYEEFCAYVIDQYQHHVSIIPGAKEFLQELYDAGIPMAVASSTPVREVRAALAAQGIEHLFKTVVSTEDVGGVDKVEPDVYLEALRRLGTDKATTWVFEDAPFGAQTAQNAGFPVVALYNDHDGRDPVFMREHSNIFAHTYGELSLLRLQDYERPLTAAPSGEKPLEVLVVGGSPEAVSHTTLSTCAQSADYLIAVDHGADACHAAGVIPQLALGDFDSATPETLAWLKEQQVPCMKFNADKYDTDLALALKSAEYEAIRRDSKLSLTVVSTSGGHLDHQLVVLGLLATWAKTGKASVRVIENDFEMRFLTAGQVDSWQLSATDVGKKMSLVALSEECEVSEAGMKWNLDHQKFTLLGDDGISNIVESDNSWVRCEKGCLLVQLWN

SEQ ID NO: 184 - DNA, 1365 bp, Atopobium parvulum
  CDS (1)..(1365): Atopobium parvulum gene encoding TMP phosphatase [WP_035433109]
atgcaggtgaccggtgcaatttttgattgcgatggaactcttgttgattcaatgcacgtttggcacaacgtttttggcgctgttcttcctaaatacggcaagactattgattcggatatttttgaccgcgtagaggctgtttccctcattggtggatgtcagatttgcgttgatgagctggatttgcctattacagcggaagctttatatgaagagttctgcgcgtacgtaactgatcagtaccgacatcatgtttcaatcattcccggtgcaaaggagttcttacaggaactccacgacgcaggcattcctatggccgttgcttcgtcaactcccgtgcgagaagttcgtgcagctctggcagctcaaggtattgagcacctctttaaaacagtggtctcaacggaagatgtggggggagtggacaaggttgagccagatgtttaccttgaggctcttcgccgtcttggcactgataaggcaactacctgggtcttcgaggatgctccgtttggcgcacagacagcacaaaatgcaggctttcctgtggctgtactctacaacgaccacgatggccgcgaccccgtctttatgcgcgagcactctaacatctttgcccacacctacggcgagctgtcgcttctgcgccttcaggactacgagcgccctctgaccgcagcgccttctggcgagaaaccccttgaggtccttgttgtgggcggatccccagaggcggtttcgcacacgacgctgtctacctgcgcccaaagcgctgactacctgatagcggttgaccatggcgcagatgtctgtcacgctgccggcgtgattccacaacttgcgcttggagactttgactccgctacaccagaaactctggcttggctcaaagagcagcaggtaccttgcatgaagtttaatgcggacaagtacgataccgacctggcgctagcattgaaatcagctgaatatgaggcaattcgtagagatagcaagctctctctgacggttgtctccacatctggcggccaccttgatcaccagcttgtagtgcttggtcttctcgccacgtgggcaaagacgggcaaggcaagcgttcgagttattgagaatgactttgagatgcgctttttagttgctggccaggtggattcttggcagctgaacactatcaatgtaggtaaaaagatttctcttgtagctttgtcagaggagtgcgaggtttctgaggccggcatgaagtggaatcttgatcaccagaagttcaccttgctgggagacgacggtatttcaaacatagttgaatcagacaattcctgggtaaggtgcgagaagggctgtcttttggtgcagctttggaactaa

SEQ ID NO: 185 - protein, 454 aa, Atopobium parvulum
MQVTGAIFDCDGTLVDSMHVWHNVFGAVLPKYGKTIDSDIFDRVEAVSLIGGCQICVDELDLPITAEALYEEFCAYVTDQYRHHVSIIPGAKEFLQELHDAGIPMAVASSTPVREVRAALAAQGIEHLFKTVVSTEDVGGVDKVEPDVYLEALRRLGTDKATTWVFEDAPFGAQTAQNAGFPVAVLYNDHDGRDPVFMREHSNIFAHTYGELSLLRLQDYERPLTAAPSGEKPLEVLVVGGSPEAVSHTTLSTCAQSADYLIAVDHGADVCHAAGVIPQLALGDFDSATPETLAWLKEQQVPCMKFNADKYDTDLALALKSAEYEAIRRDSKLSLTVVSTSGGHLDHQLVVLGLLATWAKTGKASVRVIENDFEMRFLVAGQVDSWQLNTINVGKKISLVALSEECEVSEAGMKWNLDHQKFTLLGDDGISNIVESDNSWVRCEKGCLLVQLWN

SEQ ID NO: 186 - DNA, 1383 bp, Atopobium rimae
  CDS (1)..(1383): Atopobium rimae gene encoding TMP phosphatase [WP_003148415]
atgcagataacgggtgcaatctttgatcttgatgggacactggttgactccatgtggatgtggagaagatcgttcggagatgttttagaagacctgcatatcaatatgactccggatttttttaaaagggtcgaggccatttcgctttacgatggttgcgtagcgtgtattgaggaatttaatcttcctttatccgcagaagagctgtatgaaaagttccttttgtatgtacaaacggtatattcgcacgatattaaaagcattgcgggggctaccgactttctccaggaactttttgacgcaggaatacctcttgccattgcttcttctacgccatctcgtgccatacatgttgctcttgaagcccaaggtatggagaagttttttaaagcggttgtgtgtaccgaagacgtcgggggtgtcgataaagcaaaacccgatgtctatcttgaggctctcagacgcctgggcaccgataaagcacacacgtgggtctttgaggacgctgagtttggtgtacatacggcacaaaccgagggctttcccgttgttgcgctgttcaatggcaaagacggccgtgatcttgagtatatgaaggcgcactctgatcttctcgcacatgattatcgagaactctctcttgcccgcatttacgattatgaacgggtgacgaatcagccacatctgggcgcctcatcggctcagaaggtcttttcggttctcgttgttgatggatctcccacgccaagttcagccgcgctggtttcagaactttcatcatgctcggattatgtcgttgctgcagatcgcggggcatatatctgcaaggaggccggtgtcgttcctgatattgcgtgcggagactttgattccgtgggagaagagacactctcttggatccatgcacaaaaggtgcacacgattgcttatcctcaagataagtacgagaccgatttgtctcttgcactcaatgccgcttgccatgaagcaacccgtcaagcacttccgctgtcactgacacttacctgcgcttccggcggcaggcttgatcatgagcttggtgtagtggggcttctggctcgattaagcactgcctcatggagggtgcggattgttgaggatgcctttgaagcaaggattctttcggcagatacgtatgcggcgtggaggctctcagaaaaagatcgaggaaagacactgtcggtgcttccgcttcaggaagaaacggtgattaccgagatcggtatgcaatgggaccttgcctcacgaactttgctgctcctgtctgatgaaggaatttccaatgtggtacaaacggatgtggcacaaatacattgcgagaagggcaaggcgctcgtggtgcttctcgcaaatgaatcgtga

SEQ ID NO: 187 - protein, 460 aa, Atopobium rimae
MQITGAIFDLDGTLVDSMWMWRRSFGDVLEDLHINMTPDFFKRVEAISLYDGCVACIEEFNLPLSAEELYEKFLLYVQTVYSHDIKSIAGATDFLQELFDAGIPLAIASSTPSRAIHVALEAQGMEKFFKAVVCTEDVGGVDKAKPDVYLEALRRLGTDKAHTWVFEDAEFGVHTAQTEGFPVVALFNGKDGRDLEYMKAHSDLLAHDYRELSLARIYDYERVTNQPHLGASSAQKVFSVLVVDGSPTPSSAALVSELSSCSDYVVAADRGAYICKEAGVVPDIACGDFDSVGEETLSWIHAQKVHTIAYPQDKYETDLSLALNAACHEATRQALPLSLTLTCASGGRLDHELGVVGLLARLSTASWRVRIVEDAFEARILSADTYAAWRLSEKDRGKTLSVLPLQEETVITEIGMQWDLASRTLLLLSDEGISNVVQTDVAQIHCEKGKALVVLLANES

SEQ ID NO: 188 - DNA, 1380 bp, Olsenella uli
  CDS (1)..(1380): Olsenella uli gene encoding TMP phosphatase [WP_013251930]
atgcccatcaaggccgccatcttcgactgtgacggaacgctggtcgactccatgcccctgtggcatgacgtgacggtcgaactgctgcgccgccaccatgtcgccgacgccgaggaggcgttcgtccgcaccgagtcgcttcccatggtcgagatgtgccatgccttccacgacgagtggggcgttgaggccgagggcgaggagctggtgcgcgagctggtcgatatggtccgcgaggggtatcgcagccgggttagcctgctgccgggctgccgggcgtttctggacgagctggcgtctgcgggcgtccgcatggtcgtcgcgtcgtcgacggctccggaggagctctccgtcgcgctatcggcgcagggggtcgacggctacttcgagcgggtcttctccacgggaggccccatacgcagcaaggactacccggacatctgggagctggtcctggactacctgggcaccgacccggctgacacctgggtcttcgaggacgccccgtttgggatgcggacggcccgatcggtcggcgccaacaccgtctgcctgttcagcccacacggggaccgcgaccttgcggcctgcgagcgctacgctgacatactggtccacagctaccacgagctatcgctcgccctgctggacgactacgcccgtccgccgcaagcgtccccctcggcccaccctcgcctcgcgccgcttcgcgtcctcgtcgtgggcgcctcgcccgagcgcccgtcttcggcgctgctccgctccctggccgccagtaccgactacgtcatcgccgccgacgccggggccgacgcgctgcgctcctgtggcatcgcccccgacgtcttctgcggcgacgccgactcggcaacgggcgaatcggctgcgtgggcccgctcggtcgcccgtgcggacatagagtttccctccgagaagtacgcgaccgacctcgccctcgccatctcctgcgcccgccatgaggccgctcgacgcaacgcgcggctggagctcacgctgaccggcgtcacgggcggcaggcccgaccacgcccttgccgtcgtgggtcagctcgcgcggaacgctgacgcctcgccgcgcatcgtggaggacggcttcgagtgccgactgctcagcccctctggcactgcgtgctgggagctgggtggggcccacgtgccagccgccggggtcgaggggacgctcttctcggccattcccgtggcagaggggaccatgctctccgagcggggcttcaagtgggagctggatcatcgtgagctgccccttctgggggatgagggaatctcgaacgtggtcacgtccgcgacggccagcgtcgagtgccatgccggcgcagttgcggcgttcctgttggcatag

SEQ ID NO: 189 - protein, 459 aa, Olsenella uli
MPIKAAIFDCDGTLVDSMPLWHDVTVELLRRHHVADAEEAFVRTESLPMVEMCHAFHDEWGVEAEGEELVRELVDMVREGYRSRVSLLPGCRAFLDELASAGVRMVVASSTAPEELSVALSAQGVDGYFERVFSTGGPIRSKDYPDIWELVLDYLGTDPADTWVFEDAPFGMRTARSVGANTVCLFSPHGDRDLAACERYADILVHSYHELSLALLDDYARPPQASPSAHPRLAPLRVLVVGASPERPSSALLRSLAASTDYVIAADAGADALRSCGIAPDVFCGDADSATGESAAWARSVARADIEFPSEKYATDLALAISCARHEAARRNARLELTLTGVTGGRPDHALAVVGQLARNADASPRIVEDGFECRLLSPSGTACWELGGAHVPAAGVEGTLFSAIPVAEGTMLSERGFKWELDHRELPLLGDEGISNVVTSATASVECHAGAVAAFLLA

SEQ ID NO: 190 - DNA, 762 bp, Atopobium minutum
  CDS (1)..(762): Atopobium minutum gene encoding TMP phosphatase [KRN55115]
atgtgggctaaaacctctcgacattgtacgcaaaaaggctttaccatgaaccctgcacgcattttatttgatggaggaacttgtatggcaataagcggcgcaatctttgactgtgacggcacgctggttgattctatgtatatgtggtgggacgcctttccccgcctgcttgccagccatggctttgctatgacgcctcagatcgagaaaatcttgcatgagtgtgaggcggtcagcttggatgaagagatccatacgctgcgcaacgctcttgctattcccgcttctgccgagcagctagcacaagaattatcccagaatattagcaatgcgtatgcctcagagatcaaagcatggcctgccgttaagccgttcttggatcagctcaaagacgcaggtatccccatgatcatttgtacttctaccggagccaaagaagttggtctgtgcatggatcatcttggtttgtccaagttttttgtagatattgtcagcgcggaagaaaacaatttcaccaaaactgagccagatatctattactatgcgctaaaaaagcttggtaccactaaagagacaacctgggtatttgaggatgctccgtttggccttactacctctgagcgtgcaggatttcctaatgtgtgcgtctttaatgcgcacgataagcgcgatgaggactttttgcgtcttcatgctacgttgtttacgcacatatatgaggatatttcccttgcggatttgcagtcgtaccccaccaagtaa

SEQ ID NO: 191 - protein, 253 aa, Atopobium minutum
MWAKTSRHCTQKGFTMNPARILFDGGTCMAISGAIFDCDGTLVDSMYMWWDAFPRLLASHGFAMTPQIEKILHECEAVSLDEEIHTLRNALAIPASAEQLAQELSQNISNAYASEIKAWPAVKPFLDQLKDAGIPMIICTSTGAKEVGLCMDHLGLSKFFVDIVSAEENNFTKTEPDIYYYALKKLGTTKETTWVFEDAPFGLTTSERAGFPNVCVFNAHDKRDEDFLRLHATLFTHIYEDISLADLQSYPTK

SEQ ID NO: 192 - DNA, 648 bp, Syntrophomonas wolfei
  CDS (1)..(648): Syntrophomonas wolfei gene encoding TMP phosphatase [WP_011640074]
atgggagagaaattaataatttttatggatttcgatggcactatttctcgggaggatgtctgcaataagatggcagccaggtatgccggcagggactgggaggaaataaaccgcctctgggaagagggaggtattactactggagagtgcgccagtcgtattctttcatcaatggaggtaggggcggctgaattggaggccttttttcaggctcaggaagtagaccccggcttttcccctttcctggactgggtacaaaaaaatcagcacctccccattatattgagcgatggttatgaccgctatataaaaagcatattacggggccagggctgggaaatcgagttttatgccaataaattatactgggatgacgcctggcggatggaatcgccctacctggatgaagaatgctttaaatgtggggtatgcaagagcaagataatccaggaaagaagtttacccggctatctcacagtatatatcggagatggctactccgatttctgcccggcggcctcttgtgatattgtttttgccaaaaatgaactggccggctactgccagaaagagggtttaacttactacccctaccgggattttcacgatattctccagcaactgccgaggattgttagcaggatgtag

SEQ ID NO: 193 - protein, 215 aa, Syntrophomonas wolfei
MGEKLIIFMDFDGTISREDVCNKMAARYAGRDWEEINRLWEEGGITTGECASRILSSMEVGAAELEAFFQAQEVDPGFSPFLDWVQKNQHLPIILSDGYDRYIKSILRGQGWEIEFYANKLYWDDAWRMESPYLDEECFKCGVCKSKIIQERSLPGYLTVYIGDGYSDFCPAASCDIVFAKNELAGYCQKEGLTYYPYRDFHDILQQLPRIVSRM

SEQ ID NO: 194 - DNA, 666 bp, Desulfitobacterium hafniense
  CDS (1)..(666): Desulfitobacterium hafniense gene encoding TMP phosphatase [WP_018212876]
atggaggaattgaacagtattttcttcgtggattttgacggcaccatcgtcactcaggatatgtgtgcagtcctcgttgaaaccttggccggggaaggatggcgggagattaatgaactttgggaaagaaaagagctttccaccctggagtgcgcccgccggacctttaaactctttaacagcaatgacccggaagtttttcgccagcttatcgggcaggcggtgttcgatcccggatttttagattttgccgctttttgtgaacagagaggatttcccctcatcattctcagcgacggatatgatttctatattgagtacctcttgcaaagagagggattgaacctgccatactatgccaacaaattgctgtttgctccccaacttgacgtagaaaccccctacagctccggcgaatgtgatctatgcggggtctgcaaactgcagctgatggaaaaattgcttaaacccggttgccgatccgtctatatcggagatgggacttccgatttttgcccggcggaaagggcggataaggtctttgccaggagcaggctttatcagcattgccaggaggtgggcaaagaagcccagctattccaatcgtttcaggatattcttcagacagttgaacattggggaagggaagaggaggaagggacttga

SEQ ID NO: 195 - protein, 221 aa, Desulfitobacterium hafniense
MEELNSIFFVDFDGTIVTQDMCAVLVETLAGEGWREINELWERKELSTLECARRTFKLFNSNDPEVFRQLIGQAVFDPGFLDFAAFCEQRGFPLIILSDGYDFYIEYLLQREGLNLPYYANKLLFAPQLDVETPYSSGECDLCGVCKLQLMEKLLKPGCRSVYIGDGTSDFCPAERADKVFARSRLYQHCQEVGKEAQLFQSFQDILQTVEHWGREEEEGT

SEQ ID NO: 196 - DNA, 642 bp, Pelotomaculum thermopropionicum
  CDS (1)..(642): Pelotomaculum thermopropionicum gene encoding TMP phosphatase [WP_012032097]
atggaaaaagttttttttgttgattttgacgggacggtaaccaaaaaggatacctgcgtggccatgatcgaggcctttgccggcggcaactggagagagattaacgaggcgtgggaaagaaaagaaatttccacggaagaatgtgcaaacatgatcttcaggcttttccgcgccggcattgaagacatcaggaagcttttggacggtatcgagatagacggccattttaaagattttctttctttttgccgggaaagaggctataaaatatacatcctcagcgacggttacgacttttgcattgagacggtgtttaaaaaacacggaatagagctgccgtactatgccaacaaaatggtttacggcaatggttttaaaatagaatgcttcaggcccaacccggcctgcggtatttgcgggacctgcaagaccaagctgattgaggagcttaaaggggacggcagccaggttatttacattggcgacggatattcggacacatgcccggccatgaaagccgatgtggtttttgccaagggagtattgtacaggcattgccgggaaaacggcaaaaaggctatttattataataactttggtgatattattaattattttttccaaataaaaaaaagtttgtaa

SEQ ID NO: 197 - protein, 213 aa, Pelotomaculum thermopropionicum
MEKVFFVDFDGTVTKKDTCVAMIEAFAGGNWREINEAWERKEISTEECANMIFRLFRAGIEDIRKLLDGIEIDGHFKDFLSFCRERGYKIYILSDGYDFCIETVFKKHGIELPYYANKMVYGNGFKIECFRPNPACGICGTCKTKLIEELKGDGSQVIYIGDGYSDTCPAMKADVVFAKGVLYRHCRENGKKAIYYNNFGDIINYFFQIKKSL

SEQ ID NO: 198 - DNA, 651 bp, Desulfotomaculum ruminis
  CDS (1)..(651): Desulfotomaculum ruminis gene encoding TMP phosphatase [WP_013840216]
atggaaaccattctttttctggattttgacggcaccattaccgagcaggatacctgcgatatgctgatggagcgctacggcaatgcggaatgtctggaattgaaccggcgctgggaacgcaaggaaatttccaccatggaatgtgcccggcagtccttccggcaaatgcaggtaactcccgaggttctaaagcggttggtgcaggaggtgaaggtagaccctcatttgaaagaattgctccgtttctgtgagcaggagaattaccccgcctatattttgagcgatgggtatgaacccatcattcagggggtactgcagcgggaaggaataaaaatatcttgtttttgcaacgggttgtcctttgacggccagtaccgggtcatggcgcctcactataatccccggtgcggccggtgcggaacctgtaaacaaaagctggtggaacgcctgggtcagccgggcgcccggaagatttttgtgggagacggttattcggatttctgtgccgcagagtcctgcagtaaggtctttgctaaaaaaaatttattgaagtattgcctggaaaaccagattccggcccacccctatgaaaccctgggagaggttttacagtggctgagaggagaggctgaacatggacatccggtttaa

SEQ ID NO: 199 - protein, 216 aa, Desulfotomaculum ruminis
METILFLDFDGTITEQDTCDMLMERYGNAECLELNRRWERKEISTMECARQSFRQMQVTPEVLKRLVQEVKVDPHLKELLRFCEQENYPAYILSDGYEPIIQGVLQREGIKISCFCNGLSFDGQYRVMAPHYNPRCGRCGTCKQKLVERLGQPGARKIFVGDGYSDFCAAESCSKVFAKKNLLKYCLENQIPAHPYETLGEVLQWLRGEAEHGHPV

SEQ ID NO: 200 - DNA, 1896 bp, Escherichia coli
  CDS (1)..(1896): ThiC gene from E. coli encoding HMP-P synthase
atgtctgcaacaaaactgacccgccgcgaacaacgcgcccgggcccaacattttatcgacaccctggaaggcaccgcctttcccaactcaaaacgcatttatatcactggcacacaccccggcgtgcgcgtgccgatgcgtgagatccagcttagcccgacgctaattggcggtagcaaagaacagccgcagtacgaagaaaacgaagcgattccggtctacgacacctccggcccgtatggtgatccgcagattgccattaacgtgcagcaagggctggcaaaactacgccagccgtggatcgatgcgcgcggcgataccgaagaacttaccgtgcgcagttccgattacactaaagcgcggctggcagatgatggcctcgacgaactgcgttttagcggcgtactaacaccaaaacgcgccaaagcaggacgccgtgtcacccaactgcactacgcccgccagggcatcatcacgccggaaatggaattcatcgccatccgcgagaatatgggccgcgagcgcatccgtagcgaggttttacgccaccagcatccgggaatgagctttggcgcacatctgccggaaaatatcactgcggaatttgtccgtgatgaagttgctgccggacgtgcgattatcccggccaacattaatcatccggaatcggagccgatgattattggtcgcaatttcctggtaaaagttaacgccaatatcggcaactcggcggtcacctcttccatcgaagaagaagtggaaaagctggtatggtccacgcgctggggagcggatacggtgatggatctctccaccggtcgctatattcacgaaacccgcgagtggattttgcgtaacagcccggtgccgatcggtacagtgccgatctaccaggcgctggagaaggttaacgggatcgccgaagatcttacctgggaagcgttccgcgacacgctgctggaacaggccgagcaaggtgtggattacttcactatccatgcgggcgtactgctgcgctatgtgccgatgaccgcgaaacgcctgaccggtatcgtctctcgcggcggttcgattatggcgaaatggtgcctctcccatcatcaggaaaatttcctctatcaacacttccgcgaaatttgtgaaatctgtgccgcttatgacgtttcgctgtcgctgggcgacggtctgcgccccggttctattcaggacgccaacgatgaagcgcagtttgccgagctgcatacgctgggcgaactgaccaaaattgcctgggaatatgacgtgcaggtgatgattgaaggcccaggccacgtgccgatgcagatgatccgccgcaatatgaccgaggagttagagcactgccacgaagcgccgttttacactctggggccgctaactaccgatattgcgccgggctatgaccacttcacgtcggggattggtgcggcgatgattggctggtttggctgcgcgatgctctgttacgtaacgccaaaagagcatctgggtctgcccaataaagaagatgttaagcaggggcttatcacctataagattgctgcccacgccgctgacctggcgaaagggcatccgggcgcgcaaattcgcgataacgccatgtcgaaagcccgcttcgaatttcgctgggaagaccagtttaatctggccctcgacccgtttaccgcccgcgcttatcacgatgaaaccctgccgcaagagtcaggtaaagtcgcccatttttgctccatgtgtgggccgaaattctgctcgatgaaaatcagccaggaagtgcgtgattacgccgccacgcaaactattgaaatgggaatggcggatatgtcggagaacttccgtgccagaggcggagaaatctacctgcgtaaggaggaagcgtga

SEQ ID NO: 201 - protein, 631 aa, Escherichia coli
MSATKLTRREQRARAQHFIDTLEGTAFPNSKRIYITGTHPGVRVPMREIQLSPTLIGGSKEQPQYEENEAIPVYDTSGPYGDPQIAINVQQGLAKLRQPWIDARGDTEELTVRSSDYTKARLADDGLDELRFSGVLTPKRAKAGRRVTQLHYARQGIITPEMEFIAIRENMGRERIRSEVLRHQHPGMSFGAHLPENITAEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAEDLTWEAFRDTLLEQAEQGVDYFTIHAGVLLRYVPMTAKRLTGIVSRGGSIMAKWCLSHHQENFLYQHFREICEICAAYDVSLSLGDGLRPGSIQDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKISQEVRDYAATQTIEMGMADMSENFRARGGEIYLRKEEA

SEQ ID NO: 202 - DNA, 1371 bp, Synechococcus elongatus
  CDS (1)..(1371): ThiC gene from Synechococcus_elongatus_PCC_7942:_[NC_007604] encoding a HMP-P synthase
atgcgcagcgactggatcgcaccccgccgaggccaagccaacgtcactcaaatgcactacgcccgccaaggcgtgatcaccgaagaaatggacttcgtggcgcggcgcgaaaatctgccagccgatctaattcgggatgaagtggcacggggtcggatgattatccccgccaacatcaaccacaccaatttggagccgatggcgatcggcattgcctccaagtgcaaggtcaacgccaacatcggtgcttcgcctaacgcctccaacatcgatgaagaagtcgagaagctgaagctcgcggtcaaatacggtgccgataccgtcatggacctctcgaccggcggcggcaacctcgatgagattcgcaccgcgatcatcaatgcttcgccggtaccgatcggcaccgtgccggtctaccaagccctggaatccgttcacgggcgcatcgaaaaactcagcgccgacgacttcttgcatgtgatcgaaaagcactgcgaacagggcgtcgactaccaaaccatccacgccggtctgctgattgaacacctgcccaaggtcaagagccggatcaccgggattgtttcgcggggcggcggcatcattgcccagtggatgctctaccaccacaagcaaaacccgctctatacccactttcgcgacatcatcgaaatcttcaagcgctacgactgtagcttcagcttgggtgactcgctgcggccgggttgcctgcacgatgctagcgacgatgcccagctcagcgagctgaagactctcggtcaactgacgcgggttgcttgggaacacgacgtgcaagtcatggtcgaagggccaggccacgttcccatggaccagatcgagttcaacgtccgcaagcaaatggaagagtgctcagaagctcccttctacgtcttgggtcccctcgtgaccgacattgcaccgggctatgaccacatcaccagcgcgatcggggcagcaatggcgggctggtatggcacggcaatgctctgctacgtcacgcccaaagagcacttgggtctgcccaatgcggaagatgtgcgcaatggtttgatcgcctacaaaattgcggctcatgcagcagatatcgctcgccaccgtccgggtgctcgcgatcgcgatgatgaactgagtcgggcacgctacgccttcgactggaacaagcaatttgacttgagcctcgatccagagcgggcgcgggaataccacgacgaaactctgccagcagatatctacaaaacggcagaattctgttcgatgtgtggaccgaagcactgtccgatgcaaaccaagatcaccgaggaagatctaaccgagttggaaaaattcctcgagaaagatagcgctctggcgtag

SEQ ID NO: 203 - protein, 456 aa, Synechococcus elongatus
MRSDWIAPRRGQANVTQMHYARQGVITEEMDFVARRENLPADLIRDEVARGRMIIPANINHTNLEPMAIGIASKCKVNANIGASPNASNIDEEVEKLKLAVKYGADTVMDLSTGGGNLDEIRTAIINASPVPIGTVPVYQALESVHGRIEKLSADDFLHVIEKHCEQGVDYQTIHAGLLIEHLPKVKSRITGIVSRGGGIIAQWMLYHHKQNPLYTHFRDIIEIFKRYDCSFSLGDSLRPGCLHDASDDAQLSELKTLGQLTRVAWEHDVQVMVEGPGHVPMDQIEFNVRKQMEECSEAPFYVLGPLVTDIAPGYDHITSAIGAAMAGWYGTAMLCYVTPKEHLGLPNAEDVRNGLIAYKIAAHAADIARHRPGARDRDDELSRARYAFDWNKQFDLSLDPERAREYHDETLPADIYKTAEFCSMCGPKHCPMQTKITEEDLTELEKFLEKDSALA

SEQ ID NO: 204 - DNA, 1764 bp, Corynebacterium glutamicum
  CDS (1)..(1764): ThiC gene from Corynebacterium glutamicum  encoding an HMP-P synthase
atgacgcctacccaaaatgagatccacccgaaacatagctactcccccatccgcaaggacggtctcgaggtcccggagaccgaaatccgcctcgatgactcgccaagcggccccaacgaacccttccgcatctaccgcacccgtggcccagaaaccaaccccaagcagggacttccgcggctgcgcgagtcatggatcaccgcccgcggcgacgttgccacctatcaggggcgcgagcgtttgcttatcgacgacggccgctcggcaatgcgtcgaggtcaagcttcggctgagtggaaaggccaaaaaccagctcctttgaaggcgctacctggcaaaagagtcacccaaatggcctatgcacgtgctggcgtgattactcgtgaaatggagtttgtagcgctgcgcgaacacgttgatgcggagtttgtgcgctctgaggtggcgcgcggtcgggccattattcccaacaacgtcaaccaccccgaatctgaaccgatgattattggtcgcaaatttttgaccaaaatcaacgccaatattggcaattctgcggtcacctcttcaatcgaggaagaggtgtccaagctgcagtgggccacgcgctggggtgccgataccgtgatggatctatccaccggcgatgatattcacaccacccgcgaatggattatccgcaactcccccgttcctatcggcaccgtcccgatctaccaagcgctggaaaaagtaaatggcgtggccgcagaccttaactgggaagtattccgcgataccatcattgagcagtgtgaacaaggcgtggactatatgaccatccacgccggcgtcctgctggcttatatcccactgactacccgtcgtgtcaccggcattgtctcccgcggcggatccattatggccggttggtgtctggcgcatcaccgcgaatcattcctctacgagcatttcgacgagctgtgcgaaatctttgcacaatatgacgtcgcattctccctcggtgatggcctacgccccggatcgcttgccgatgccaacgacgccgcgcaattcgccgagctgaaaaccattggtgagctcacccaacgcgcctgggaatacgatgtacaagtaatggtcgaaggacctggacacgtgccactaaacatgatccaggaaaacaacgagctggaacaaaagtgggcagcggacgcacctttttacactcttggaccactagttaccgacatcgctccaggttatgaccacatcacttctgccattggtgcagctcacatcgccatgggtggcaccgccatgctgtgttatgtcaccccgaaagaacaccttggcctgcccaaccgtgacgacgtcaaaaccggcgtaatcacctacaagctcgctgcccacgcagcagatgtggccaagggtcatcccggcgcgcgtgcctgggacgacgccatgagtaaagcgcgttttgaattccgttggaatgatcagtttgcgctctccctcgaccccgacactgcaatcgcttatcacgacgaaaccctgccggcagagcctgcgaaaaccgcacacttctgttcaatgtgtggcccgaagttctgctccatgcgaattagccaggacattcgcgatatgtttggcgatcaaatcgcggaattggggatgcctggggttggggattcttctagtgctgttgcttctagtggggcacgggaggggatggctgagaaatcccgggaatttattgctggtggtgcggaggtttatcggcgttag

SEQ ID NO: 205 - protein, 587 aa, Corynebacterium glutamicum
MTPTQNEIHPKHSYSPIRKDGLEVPETEIRLDDSPSGPNEPFRIYRTRGPETNPKQGLPRLRESWITARGDVATYQGRERLLIDDGRSAMRRGQASAEWKGQKPAPLKALPGKRVTQMAYARAGVITREMEFVALREHVDAEFVRSEVARGRAIIPNNVNHPESEPMIIGRKFLTKINANIGNSAVTSSIEEEVSKLQWATRWGADTVMDLSTGDDIHTTREWIIRNSPVPIGTVPIYQALEKVNGVAADLNWEVFRDTIIEQCEQGVDYMTIHAGVLLAYIPLTTRRVTGIVSRGGSIMAGWCLAHHRESFLYEHFDELCEIFAQYDVAFSLGDGLRPGSLADANDAAQFAELKTIGELTQRAWEYDVQVMVEGPGHVPLNMIQENNELEQKWAADAPFYTLGPLVTDIAPGYDHITSAIGAAHIAMGGTAMLCYVTPKEHLGLPNRDDVKTGVITYKLAAHAADVAKGHPGARAWDDAMSKARFEFRWNDQFALSLDPDTAIAYHDETLPAEPAKTAHFCSMCGPKFCSMRISQDIRDMFGDQIAELGMPGVGDSSSAVASSGAREGMAEKSREFIAGGAEVYRR

SEQ ID NO: 206 - DNA, 1869 bp, Candidatus Baumannia cicadellinicola
  CDS (1)..(1869): ThiC gene from Candidatus Baumannia cicadellinicola [WP_011520252] encoding HMP-P synthase
atgtcaagatcatcaatacctgcttcacgccgagtgagccgtgcaaaagcacaggcttttatggatagcttaacaggtagtagctattttcctaactcaagaaggatatatttacaaggtaaaacaccttcagtacatgtaccaatgcgtgaaattaagctacatcctacattgatcggtaaaaacggtgaacattatgaggataatcaacctataccagtttatgatacttcaggtccttacggtgatcctactatagcaattaacgtacgtacaggtcttaaccggttacgcgagatatggattcttgcacgacaagatagtgagccaataagtaataataataacgatcgtcagagttcagataaacagttaagttttactactaactataatccacgccgagctagctatggacgctgtattacacaattacattacgcacgtgccggtatcataacgccagaaatggagtttatagctttacgtgaaaatatgggccgagaacgtattagtagcaacgtgctacatcagcagcatttaggttctaactttggtgctaaaaaagctgatcatattacagcagaatttgtccggcaggaagtagcagcaggacgtgctattatacctagtaatattaatcatccagaatctgagccaatgatcattggccgtaattttctcgtaaaagtaaatgcaaatattggtaactcagcagtaacatcttctattgaggaagaagtcgaaaagttagtatgggctactcgttggggagctgatacagtcatggacttatctactggtagttatattcacgaaactagagaatggatattacgtaatagcccagtacctataggtactgtacctatctatcaagcgttagaaaaagtaaatggagtcatagaaaatcttaattgggatattttctacgagacattattagaacaagctaaccaaggagtagattattttacgattcatgctggcgtattaaaacgttatgttctactaacagctagtaggttaactggtatcgtatcgcgtggtggctctattatggctcaatggagtttagtacataatcaggaaaacttcctttatgagcattttagtgaaatttgcaagctttgtgctgcttatgatattgctctatctcttggagatggtctaagacccggttccgtacaagatgctaatgatgaagcacaattttctgagttacatacactaggcgaattaactaaaattgcctgggaatatgatgtgcaagtaatgatcgaaggacctggtcatattccactacatatgattgagcgtaatatgactgatcaacttaaatattgccacgaagcaccattctacactctcggaccactcacaacagatattgctcctggttatgaccactttacttcaggtattggtgccgcactaataggctggtttggatgtgctatgctgtgctatgtaactcctaaagagcatctaggtttacctaataaggaagacgtaaaacagggtttaattgcctataaaattgccgcacatgctgcagatctagctaaaggacatcctggtgctcaaatacgtgataatgctatgtcaaaagctcgtttcgaatttcgctgggaagatcaatttaacttagctttagatccttttacggcgcgtatgtatcacgatgaaactataccgcaaacagcaggaaaattagcaaatttttgctcgatgtgtggtcctaagttttgttctatgaagctatcaaaaaaaatacgtaattacactaatatgaaaaatataaaaactattagtaatagtttcatgaataaattagataatagcggtattaaaaatgctgaccgataa

SEQ ID NO: 207 - protein, 622 aa, Candidatus Baumannia cicadellinicola
MSRSSIPASRRVSRAKAQAFMDSLTGSSYFPNSRRIYLQGKTPSVHVPMREIKLHPTLIGKNGEHYEDNQPIPVYDTSGPYGDPTIAINVRTGLNRLREIWILARQDSEPISNNNNDRQSSDKQLSFTTNYNPRRASYGRCITQLHYARAGIITPEMEFIALRENMGRERISSNVLHQQHLGSNFGAKKADHITAEFVRQEVAAGRAIIPSNINHPESEPMIIGRNFLVKVNANIGNSAVTSSIEEEVEKLVWATRWGADTVMDLSTGSYIHETREWILRNSPVPIGTVPIYQALEKVNGVIENLNWDIFYETLLEQANQGVDYFTIHAGVLKRYVLLTASRLTGIVSRGGSIMAQWSLVHNQENFLYEHFSEICKLCAAYDIALSLGDGLRPGSVQDANDEAQFSELHTLGELTKIAWEYDVQVMIEGPGHIPLHMIERNMTDQLKYCHEAPFYTLGPLTTDIAPGYDHFTSGIGAALIGWFGCAMLCYVTPKEHLGLPNKEDVKQGLIAYKIAAHAADLAKGHPGAQIRDNAMSKARFEFRWEDQFNLALDPFTARMYHDETIPQTAGKLANFCSMCGPKFCSMKLSKKIRNYTNMKNIKTISNSFMNKLDNSGIKNADR

SEQ ID NO: 208 - DNA, 636 bp, Escherichia coli
  CDS (1)..(636): ThiE gene from E. coli encoding thiamine phosphate synthase
atgtatcagcctgattttcctcctgtaccttttcgttcaggactgtacccggtggtggacagcgtacagtggatcgaacgtctgttggatgcaggcgtacgtactctccagctacgcatcaaagatcggcgcgatgaagaggtggaagccgatgtcgtggcggcaattgcgctgggccgccgctataacgcgcgattgtttatcaacgattactggcggctggcgatcaagcatcaggcgtatggcgtccatttggggcaggaagatttgcaagccaccgatctcaatgccatccgcgcggcaggcctgcggctgggcgtttcgacacatgacgatatggaaatcgacgtcgcgctggcagcacgcccctcttatatcgcgctgggacatgtgttcccgacgcaaaccaaacagatgccttctgcaccgcaggggctggaacagctggcacggcatgttgagcgactggcggattatcccaccgtggcgattggcggtatcagtctggcacgcgcgcctgcggtgatagcaacgggtgtcggcagtatcgccgtcgtcagcgccattactcaagccgcagactggcgtttggcaacggcacagttgctggaaattgcaggagttggcgatgaatga

SEQ ID NO: 209 - protein, 211 aa, Escherichia coli
MYQPDFPPVPFRSGLYPVVDSVQWIERLLDAGVRTLQLRIKDRRDEEVEADVVAAIALGRRYNARLFINDYWRLAIKHQAYGVHLGQEDLQATDLNAIRAAGLRLGVSTHDDMEIDVALAARPSYIALGHVFPTQTKQMPSAPQGLEQLARHVERLADYPTVAIGGISLARAPAVIATGVGSIAVVSAITQAADWRLATAQLLEIAGVGDE

SEQ ID NO: 210 - DNA, 756 bp, Escherichia coli
  CDS (1)..(756): ThiF gene from E.coli encoding a ThiS adenylyltransferase
atgaatgaccgtgactttatgcgttatagccgccaaatcctgctcgacgatatcgctctggacgggcagcaaaaactgctcgacagccaggtgctgattatcggtctgggcgggctgggtacacctgctgcgctgtacctggcgggcgctggcgtcgggacgctggtactggcagatgacgacgatgtgcatttaagcaatctgcaacgacaaatcctctttaccactgaagatatcgatcgcccgaaatcgcaggtcagccaacagcgactgacacagttgaatcccgacattcaactgacagcattacaacaacggttaacgggtgaggcgttaaaagatgcggttgcacgggccgatgtggtgctcgactgtaccgacaatatggcgactcgccaggagattaatgccgcctgcgtggcactcaacacgccgcttatcaccgccagcgcggtcggatttggcggtcagttgatggtactgacgccgccctgggagcaggggtgttaccgctgcctgtggccagataaccaggagccagaacgcaactgccgcacggcgggcgtggttggcccggtggtcggggttatgggcactttgcaggcactggaagccattaagttattaagcggtatagagacacctgcgggagaactccgactgttcgacggtaaatcgagccagtggcgcagcctggcgttgcgccgcgccagtggttgcccggtatgcggaggaagcaatgcagatcctgtttaa

SEQ ID NO: 211 - protein, 251 aa, Escherichia coli
MNDRDFMRYSRQILLDDIALDGQQKLLDSQVLIIGLGGLGTPAALYLAGAGVGTLVLADDDDVHLSNLQRQILFTTEDIDRPKSQVSQQRLTQLNPDIQLTALQQRLTGEALKDAVARADVVLDCTDNMATRQEINAACVALNTPLITASAVGFGGQLMVLTPPWEQGCYRCLWPDNQEPERNCRTAGVVGPVVGVMGTLQALEAIKLLSGIETPAGELRLFDGKSSQWRSLALRRASGCPVCGGSNADPV

SEQ ID NO: 212 - DNA, 201 bp, Escherichia coli
  CDS (1)..(201): ThiS gene from E. coli encoding Sulfur-carrier protein
atgcagatcctgtttaacgatcaagcgatgcagtgcgccgccgggcaaactgttcacgaactactggagcaactcgaccaacgacaagcgggcgcggctctggcgattaatcagcaaatcgtcccgcgtgagcagtgggcgcaacatatcgtgcaggatggcgaccagatcctgctttttcaggttattgcagggggttga

SEQ ID NO: 213 - protein, 66 aa, Escherichia coli
MQILFNDQAMQCAAGQTVHELLEQLDQRQAGAALAINQQIVPREQWAQHIVQDGDQILLFQVIAGG

SEQ ID NO: 214 - DNA, 771 bp, Escherichia coli
  CDS (1)..(771): ThiG gene from E. coli encoding Thiazole synthase
atgttacgtattgcggacaaaacgtttgattcacatctgtttaccggcacagggaaattcgcttcttcacaactgatggtggaggcgatccgcgcttccggcagccagctggtgacactggcgatgaaacgtgtcgacttgcgccagcacaacgacgctatcctcgaaccgcttatcgcggcgggtgtgaccctgctgccaaatacatccggggcgaaaacagcggaagaagccattttcgccgcccatctggctcgtgaagcgttaggcacaaactggttaaaattagagattcaccctgacgcccgctggctgttgcccgatcccatcgaaaccctgaaagccgccgaaacgctggtacaacagggatttgtcgtgctgccttactgcggggccgatccggtattgtgtaaacgtctggaagaagtcggctgtgcagcggtgatgccgctcggcgcgccgattggctcgaatcagggactggaaacccgcgccatgctggagattattatccagcaggccacagtgccggtggttgtcgatgctggcatcggcgttcccagccatgccgcgcaggcgctggaaatgggggccgacgcggtgttagtgaatacggcgattgccgtcgcggacgatcccgtcaacatggcgaaggcatttcgtctggcggtagaagcaggcctactggcacgtcagtccggaccgggcagccgcagttattttgctcatgccaccagcccgctgaccggatttctggaggcatcggcatga

SEQ ID NO: 215 - protein, 256 aa, Escherichia coli
MLRIADKTFDSHLFTGTGKFASSQLMVEAIRASGSQLVTLAMKRVDLRQHNDAILEPLIAAGVTLLPNTSGAKTAEEAIFAAHLAREALGTNWLKLEIHPDARWLLPDPIETLKAAETLVQQGFVVLPYCGADPVLCKRLEEVGCAAVMPLGAPIGSNQGLETRAMLEIIIQQATVPVVVDAGIGVPSHAAQALEMGADAVLVNTAIAVADDPVNMAKAFRLAVEAGLLARQSGPGSRSYFAHATSPLTGFLEASA

SEQ ID NO: 216 - DNA, 1134 bp, Escherichia coli
  CDS (1)..(1134): ThiH gene from E. coli encoding 2-iminoacetate synthase
atgaaaaccttcagcgatcgctggcgacaactggactgggacgacatccgcctgcgtatcaacggcaaaacggctgctgacgtagagcgggcgctaaatgcctcgcaactcacccgcgacgacatgatggcgctgttatcgcctgccgccagtggctatctggaacaactggcccaacgggcgcagcgtctgacccgtcagcgatttggcaacacagttagtttctacgtcccgctttatctttccaatctttgcgctaacgactgcacgtactgtggattttccatgagtaatcgcatcaagcgcaaaacgctggatgaagcggatattgccagggaaagtgccgctatacgggagatgggctttgaacatctgctgttagtcactggtgaacatcaggcgaaagtggggatggattactttcgtcgtcatctccctgcccttcgtgaacagttctcttcactacagatggaagtgcaaccgctggcggagacggaatacgccgagttaaagcaacttggtctggatggcgtgatggtttatcaggagacatatcacgaggcgacttatgcccgccatcatctgaaaggcaaaaaacaggacttcttctggcggctggaaacgccggatcggctggggcgtgcggggattgataagataggcctcggcgcgctaattggcctttccgacaactggcgcgttgacagctatatggttgccgaacatttgctatggctgcaacagcattactggcaaagccgttactctgtctcctttccgcgcctgcgcccgtgtactggcggcattgagcctgcgtcgattatggatgaacgccagttagtgcaaaccatctgcgccttccgactgcttgcaccggagattgaactgtcactctccacgcgggaatcaccgtggtttcgcgatcgcgttattccgctggcgatcaataacgtcagcgccttctcgaaaacgcagccaggtggctatgccgataatcaccccgagttggaacagttctcaccgcacgacgatcgcagaccggaagcggttgctgccgcgttaaccgctcagggtttgcagccggtatggaaagactgggacagctatctgggacgcgcctcgcaaagactatga

SEQ ID NO: 217 - protein, 377 aa, Escherichia coli
MKTFSDRWRQLDWDDIRLRINGKTAADVERALNASQLTRDDMMALLSPAASGYLEQLAQRAQRLTRQRFGNTVSFYVPLYLSNLCANDCTYCGFSMSNRIKRKTLDEADIARESAAIREMGFEHLLLVTGEHQAKVGMDYFRRHLPALREQFSSLQMEVQPLAETEYAELKQLGLDGVMVYQETYHEATYARHHLKGKKQDFFWRLETPDRLGRAGIDKIGLGALIGLSDNWRVDSYMVAEHLLWLQQHYWQSRYSVSFPRLRPCTGGIEPASIMDERQLVQTICAFRLLAPEIELSLSTRESPWFRDRVIPLAINNVSAFSKTQPGGYADNHPELEQFSPHDDRRPEAVAAALTAQGLQPVWKDWDSYLGRASQRL

SEQ ID NO: 218 - DNA, 1110 bp, Escherichia coli
  CDS (1)..(1110): ThiO gene from E. coli encoding Glycine oxidase
atgaaaaggcattatgaagcagtggtgattggaggcggaattatcggttccgcaattgcttattatttggcaaaggaaaacaaaaacaccgcattgtttgaaagcggaacaatgggcggcagaacgacaagtgccgctgccggaatgctgggcgcccatgccgaatgcgaggaacgtgacgcgttttttgatttcgctatgcacagtcagcgtctgtacaaaggtcttggagaagagctttatgcattatccggtgtggatatcaggcagcataacggcggtatgtttaagcttgcattttctgaagaagatgtgctgcagctgagacagatggacgatttggactctgtcagctggtattcaaaagaagaggtgttagaaaaagagccgtatgcgtctggtgacatctttggtgcatcttttattcaggatgatgtgcatgtggagccttattttgtttgcaaggcatatgtgaaagcagcaaaaatgcttggggcggagatttttgagcatacgcccgtcctgcatgtcgaacgtgacggtgaagccctgttcatcaagacccctagcggagacgtatgggctaatcatgttgtcgttgccagcggggtgtggagcggaatgttttttaaacagcttggactgaacaatgcttttctccctgtaaaaggggagtgcctgtccgtttggaatgatgatatcccgctgacaaaaacgctttaccatgatcactgctatatcgtaccgagaaaaagcggaagactggttgtcggcgcgacaatgaagccgggggactggagtgaaacaccggatcttggcggattggaatctgttatgaaaaaagcaaaaacgatgctgccggctatacagaatatgaaggtggatcgtttttgggcgggactccgtccgggaacaaaggatggaaaaccgtacatcggcagacatcctgaggacagccgtattttatttgcggctggccatttcagaaacgggatcctgcttgctcccgcaacgggcgctttgatcagtgatctcatcatgaataaagaggtcaaccaagactggctgcacgcattccgaattgatcgcaaggaggcggttcagatatga

SEQ ID NO: 219 - protein, 369 aa, Escherichia coli
MKRHYEAVVIGGGIIGSAIAYYLAKENKNTALFESGTMGGRTTSAAAGMLGAHAECEERDAFFDFAMHSQRLYKGLGEELYALSGVDIRQHNGGMFKLAFSEEDVLQLRQMDDLDSVSWYSKEEVLEKEPYASGDIFGASFIQDDVHVEPYFVCKAYVKAAKMLGAEIFEHTPVLHVERDGEALFIKTPSGDVWANHVVVASGVWSGMFFKQLGLNNAFLPVKGECLSVWNDDIPLTKTLYHDHCYIVPRKSGRLVVGATMKPGDWSETPDLGGLESVMKKAKTMLPAIQNMKVDRFWAGLRPGTKDGKPYIGRHPEDSRILFAAGHFRNGILLAPATGALISDLIMNKEVNQDWLHAFRIDRKEAVQI

SEQ ID NO: 220 - DNA, 1098 bp, Pseudomonas putida
  CDS (1)..(1098): ThiO gene from Pseudomonas putida  encoding a Glycine oxidase
atgagcaagcaagtagtggtggtcggtggcggggtcattggcctgctgacggcattcaacctggcggcgagcgtcgaccaggtggtggtatgcgaccagggcgaagtagggcgcgagtcctcctgggctgggggcggtatcgtctcgcccctgtatccttggcgctacagcccggcagtgaccgccctggcgcattggtcgcaggacttttacccacagttgggcgagcgcttgttcgccagcacgggcctggatcctgaggtgcataccaccgggctttactggctcgacctggatgaccaagcccaggccttggcgtgggcaggccgtcagcagcgtccgctgagcgccgtggatatttcagcggtgtacgacgcagtccctgtgctggggccaggctttgagcgagccctctacatggaaggcgtggccaatgtgcgcaacccgcgcctggtcaaatcgctgaaggcggcgttgctggcattgcccaatgtgagcgtgcgcgagcactgccagatcacggggttcgtgcagcagggcgctcgtatcattggggtgagcaccgctgaaggcgagctggccgccgacgaagtcgtactgagcgccggtgcctggagcggcgaactgctgcgccacttgggccttgagcttccagtcgagccggtaaaagggcagatgatcctgttcaaatgcgctgaagattttctgccaagcatggtgcttgccaaaggtcgttatgcaattccgcgtcgggatggtcacattctggtgggcagcacgctggagcatgccggctacgacaagacacccaccgatgaggcgttggccagcctcaaggcatcggcggtggatctgctgcccggcctggaaggcgcgcacgtggttgcccactgggccgggctgcggccaggttcgccagaaggcgttccgtttatcgggccggtacccggcttcgatgggttatggctgaactgcggccattaccgaaacgggctggtgctggcgcccgcttcgtgccaactgctggccgatttgctcaatggcgccgagcccatcatcgacccgtcaccctacgccccgtctgggcgccttggctaa

SEQ ID NO: 221 - protein, 365 aa, Pseudomonas putida
MSKQVVVVGGGVIGLLTAFNLAASVDQVVVCDQGEVGRESSWAGGGIVSPLYPWRYSPAVTALAHWSQDFYPQLGERLFASTGLDPEVHTTGLYWLDLDDQAQALAWAGRQQRPLSAVDISAVYDAVPVLGPGFERALYMEGVANVRNPRLVKSLKAALLALPNVSVREHCQITGFVQQGARIIGVSTAEGELAADEVVLSAGAWSGELLRHLGLELPVEPVKGQMILFKCAEDFLPSMVLAKGRYAIPRRDGHILVGSTLEHAGYDKTPTDEALASLKASAVDLLPGLEGAHVVAHWAGLRPGSPEGVPFIGPVPGFDGLWLNCGHYRNGLVLAPASCQLLADLLNGAEPIIDPSPYAPSGRLG

SEQ ID NO: 222 - DNA, 1140 bp, Synechococcus elongatus
  CDS (1)..(1140): ThiO gene from Synechococcus elongatus encoding a Glycine oxidase
atggcgttcgaggtagccgtctttgggggcggcgtcattggcttggcgatcgcgctagaactgcgatcgcgaggcgcgatggtgcaggtctacagtcaaaacactcaggcggcggcaggtcgtgtggcagcagggatgttggcgccccagtcggaaggcatcgaagtcgggcccatgctggatctggggctgcgcagccgatcgctctacgcccgctggacccagcaactcgaacaactcagcggtcaagacagtggctactggccctgcggcattttggtgcccctgagtgaggccaaaaatcgcgatcgctatcctcatccagcagaatctccggggcaatggctctcggcagcggacttacgagactttcagcccgcactatgctctgacctaatcggtggctggtggttttcccaagaagggcaagttgatagtcgccgtgccctgtatccagcgctgcgagccgccgcgatcgccagtggcgtcacgatccatgaaagcgtggcgctgcgggagttatctgtaacaggcgatcgcctgcaatccgcgatgaccgatcgcgggccagttcaagctgacgcctacgttctggcaaccggcgcttggtccggcgactggctacaactgccggtctatcccgttaaaggccaaatgttctcgctgcaagctgacccgcgtttgctgaaccacgttttgtttggtgagcgggtgtatattgtgccgcgccgagatggtctgattgtggtcggtgccaccatggaagcgacggcgggattcaggactggcaacaccgctggccccttacagagcttgatggccgaggcgatcgccctcgttccggctctggcggactgtccactggttgaaacttggtggggataccgtcccgcgacaccagatgaatggccgatcctggggcaaggccccgctgagaacttattcttggcgaccggccactaccgcaacggtatgctgctcgccccaattaccgctcagctactcgctgaccaaattctcgaccactgcacggatcaactgcttcatgccttccgttacgaccgcttctccagccatgactccagcacccatcaacccttacccgctcttgcaggcttgtcagcgtcaacgggtcagtga

SEQ ID NO: 223 - protein, 379 aa, Synechococcus elongatus
MAFEVAVFGGGVIGLAIALELRSRGAMVQVYSQNTQAAAGRVAAGMLAPQSEGIEVGPMLDLGLRSRSLYARWTQQLEQLSGQDSGYWPCGILVPLSEAKNRDRYPHPAESPGQWLSAADLRDFQPALCSDLIGGWWFSQEGQVDSRRALYPALRAAAIASGVTIHESVALRELSVTGDRLQSAMTDRGPVQADAYVLATGAWSGDWLQLPVYPVKGQMFSLQADPRLLNHVLFGERVYIVPRRDGLIVVGATMEATAGFRTGNTAGPLQSLMAEAIALVPALADCPLVETWWGYRPATPDEWPILGQGPAENLFLATGHYRNGMLLAPITAQLLADQILDHCTDQLLHAFRYDRFSSHDSSTHQPLPALAGLSASTGQ

SEQ ID NO: 224 - DNA, 801 bp, Escherichia coli
  CDS (1)..(801): ThiD gene from E. coli encoding phosphohydroxymethylpyrimidine kinase
atgaaacgaattaacgctctgacgattgccggtactgatccgagtggtggtgcggggattcaggccgatcttaaaaccttctcggcacttggcgcttatggttgctcagttattactgcactggtggcgcaaaatacccgtggcgtacagtcggtgtatcgcattgagcctgattttgtcgccgcccagctcgattcggtgttcagcgatgtgcgaatcgataccactaaaatcggtatgctggcggaaaccgatattgttgaagcggtggcagaacggttgcaacgttatcagatccaaaacgtggtactcgacaccgttatgctggcaaaaagcggcgacccgctgctttcaccttcggcggttgctacgctgcgcagtcgattattgccacaggtttcattaataacgccaaacttgcccgaagctgccgccttgctcgacgcgccacacgcgcgcaccgaacaggaaatgctggaacaagggcgatcgctgttggcgatgggctgtggcgcagtgctaatgaaaggtggtcatctggatgatgagcaaagcccggactggctgtttacccgcgagggtgaacaacggtttaccgcaccgcgcattatgaccaaaaacacccacggcactggttgtacactctctgcggcgttggctgcactacgcccgcgccatacaaactgggctgacaccgtacaggaggcaaaaagctggctttcatcggcgttagcccaggccgacacgctggaagttggtcacggtattggtccggttcaccacttccacgcctggtggtga

SEQ ID NO: 225 - protein, 266 aa, Escherichia coli
MKRINALTIAGTDPSGGAGIQADLKTFSALGAYGCSVITALVAQNTRGVQSVYRIEPDFVAAQLDSVFSDVRIDTTKIGMLAETDIVEAVAERLQRYQIQNVVLDTVMLAKSGDPLLSPSAVATLRSRLLPQVSLITPNLPEAAALLDAPHARTEQEMLEQGRSLLAMGCGAVLMKGGHLDDEQSPDWLFTREGEQRFTAPRIMTKNTHGTGCTLSAALAALRPRHTNWADTVQEAKSWLSSALAQADTLEVGHGIGPVHHFHAWW

SEQ ID NO: 226 - DNA, 789 bp, Escherichia coli
  CDS (1)..(789): ThiM gene from E. coli encoding a Hydroxyethylthiazole kinase
atgcaagtcgacctgctgggttcagcgcaatctgcgcacgcgttacacctttttcaccaacattcccctcttgtgcactgcatgaccaatgatgtggtgcaaacctttaccgccaataccttgctggcgctcggtgcatcgccagcgatggttatcgaaaccgaagaggccagtcagtttgcggctatcgccagtgccttgttgattaacgttggcacactgacgcagccacgcgctcaggcgatgcgtgctgccgttgagcaagcaaaaagctctcaaacaccctggacgcttgatccagtagcggtgggtgcgctcgattatcgccgccatttttgtcatgaacttttatcttttaaaccggcagcgatacgtggtaatgcttcggaaatcatggcattagctggcattgctaatggcggacggggagtggataccactgacgccgcagctaacgcgatacccgctgcacaaacactggcacgggaaactggcgcaatcgtcgtggtcactggcgagatggattatgttaccgatggacatcgtatcattggtattcacggtggtgatccgttaatgaccaaagtggtaggaactggctgtgcattatcggcggttgtcgctgcctgctgtgcgttaccaggcgatacgctggaaaatgtcgcatctgcctgtcactggatgaaacaagccggagaacgcgcagtcgccagaagcgaggggccaggcagttttgttccacatttccttgatgcgctctggcaattgacgcaggaggtgcaggcatga

SEQ ID NO: 227 - protein, 262 aa, Escherichia coli
MQVDLLGSAQSAHALHLFHQHSPLVHCMTNDVVQTFTANTLLALGASPAMVIETEEASQFAAIASALLINVGTLTQPRAQAMRAAVEQAKSSQTPWTLDPVAVGALDYRRHFCHELLSFKPAAIRGNASEIMALAGIANGGRGVDTTDAAANAIPAAQTLARETGAIVVVTGEMDYVTDGHRIIGIHGGDPLMTKVVGTGCALSAVVAACCALPGDTLENVASACHWMKQAGERAVARSEGPGSFVPHFLDALWQLTQEVQA

SEQ ID NO: 228 - DNA, 978 bp, Escherichia coli
  CDS (1)..(978): ThiL gene from E. coli encoding thiamine-phosphate kinase (Note: mutation at nucleotides 133-135 (GGT to GAC) encodes a G133D substitution)
atggcatgtggcgagttctccctgattgcccgttattttgaccgtgtaagaagttctcgtcttgatgtcgaactgggcatcggcgacgattgcgcacttctcaatatccccgagaaacagaccctggcgatcagcactgatacgctggtggcgggtaaccatttcctccctgatatcgatcctgctgatctggcttataaagcactggcggtgaacctaagcgatctggcagcgatgggggccgatccggcctggctgacgctggcattaaccttaccggacgtagacgaagcgtggcttgagtccttcagcgacagtttgtttgatcttctcaattattacgatatgcaactcattggcggcgataccacgcgtgggccattatcaatgacgttgggtatccacggctttgttccgatgggacgagccttaacgcgctctggggcgaaaccgggtgactggatctatgtgaccggtacaccgggcgatagcgccgccgggctggcgattttgcaaaaccgtttgcaggttgccgatgctaaagatgcggactacttgatcaaacgtcatctccgtccatcgccgcgtattttacaggggcaggcactgcgcgatctggcaaattcagccatcgatctctctgacggtttgatttccgatctcgggcatatcgtgaaagccagcgactgcggcgcacgtattgacctggcattgctgccgttttctgatgcgctttctcgccatgttgaaccggaacaggcgctgcgctgggcgctctctggcggtgaagattacgagttgtgtttcactgtgccggaactgaaccgtggcgcgctggatgtggctctcggacacctgggcgtaccgtttacctgtatcgggcaaatgaccgccgatatcgaagggctttgttttattcgtgacggcgaacctgttacattagactggaaaggatatgaccattttgccacgccataa

SEQ ID NO: 229 - protein, 325 aa, Escherichia coli
MACGEFSLIARYFDRVRSSRLDVELGIGDDCALLNIPEKQTLAISTDTLVAGNHFLPDIDPADLAYKALAVNLSDLAAMGADPAWLTLALTLPDVDEAWLESFSDSLFDLLNYYDMQLIGGDTTRGPLSMTLGIHGFVPMGRALTRSGAKPGDWIYVTGTPGDSAAGLAILQNRLQVADAKDADYLIKRHLRPSPRILQGQALRDLANSAIDLSDGLISDLGHIVKASDCGARIDLALLPFSDALSRHVEPEQALRWALSGGEDYELCFTVPELNRGALDVALGHLGVPFTCIGQMTADIEGLCFIRDGEPVTLDWKGYDHFATP

SEQ ID NO: 230 - DNA, 47 bp, Escherichia coli
  promoter (1)..(47): apFAB46 promoter
aaaaagagtattgacttcgcatctttttgtacctataatagattcat

SEQ ID NO: 231 - DNA, 37 bp, Escherichia coli
  promoter (1)..(37): apFAB70 promoter
ttgacatcgcatctttttgtacctataatgtgtggat

SEQ ID NO: 232 - DNA, 37 bp, Escherichia coli
  promoter (1)..(37): apFAB71 promoter
ttgacatcgcatctttttgtacctataatagattcat

SEQ ID NO: 233 - DNA, 29 bp, Escherichia coli
  promoter (1)..(29): pBAD Ara promoter
ctgacgctttttatcgcaactctctactg

SEQ ID NO: 234 - DNA, 74 bp, Escherichia coli
  promoter (1)..(74): lac Promoter with lacO operator site
agctgtttcctgtgtgaaattgttatccgctcacaattccacacaacatacgagccggaagcataaagtgtaaa

SEQ ID NO: 235 - DNA, 91 bp, Escherichia coli
  terminator (1)..(91): apFAB378 terminator
gagttggtagctcttgatccggcaaacaaaccaccgttggtagcggtggtttttttgtttgcaagcagcagattacgcgcagaaaaaaagg

SEQ ID NO: 236 - DNA, 91 bp, Escherichia coli
  terminator (1)..(91): apFAB377 terminator
atgaccatctacattactgagctaataacaggcctgctggtaatcgcaggcctttttatttgggggagagggaagtcatgaaaaaactaac

SEQ ID NO: 237 - DNA, 90 bp, Escherichia coli
  terminator (1)..(90): apFAB381 terminator
accctcaagagaaaatgtaaccaactcactggctcaccttcacgggtgggcctttcttcgttccgggcattaaccctcactaacaggaga

SEQ ID NO: 238 - DNA, 258 bp, Artificial Sequence
  CDS (1)..(258): Synthetic gene encoding a  E2 hybrid polypeptide (subunit of pyruvate dehydrogenase)
atggctatcgaaatcaaagtaccggacatcggggctgatgaagttgaaatcaccgagatcctggtcaaagtgggcgacaaagttgaagccgaacagtcgctgatcaccgtagaaggcgacaaagcttctatggaagttccggcgccgtttgcaggcgtcgtgaaggaactgaaagtcaacgttggcgataaagtgaaaactggctcgctgattatgatcttcgaagttgaaggcgcagcgcctgcggcagctcctgcg

SEQ ID NO: 239 - protein, 86 aa, Artificial Sequence
MAIEIKVPDIGADEVEITEILVKVGDKVEAEQSLITVEGDKASMEVPAPFAGVVKELKVNVGDKVKTGSLIMIFEVEGAAPAAAPA

SEQ ID NO: 240 - DNA, 747 bp, Escherichia coli
  CDS (1)..(747): fpr gene_E. coli encoding a flavodoxin/ferredoxin reductase
atggctgattgggtaacaggcaaagtcactaaagtgcagaactggaccgacgccctgtttagtctcaccgttcacgcccccgtgcttccgtttaccgccgggcaatttaccaagcttggccttgaaatcgacggcgaacgcgtccagcgcgcctactcctatgtaaactcgcccgataatcccgatctggagttttacctggtcaccgtccccgatggcaaattaagcccacgactggcggcactgaaaccaggcgatgaagtgcaggtggttagcgaagcggcaggattctttgtgctcgatgaagtgccgcactgcgaaacgctatggatgctggcaaccggtacagcgattggcccttatttatcgattctgcaactaggtaaagatttagatcgcttcaaaaatctggtcctggtgcacgccgcacgttatgccgccgacttaagctatttgccactgatgcaggaactggaaaaacgctacgaaggaaaactgcgcattcagacggtggtcagtcgggaaacggcagcggggtcgctcaccggacggataccggcattaattgaaagtggggaactggaaagcacgattggcctgccgatgaataaagaaaccagccatgtgatgctgtgcggcaatccacagatggtgcgcgatacacaacagttgctgaaagagacccggcagatgacgaaacatttacgtcgccgaccgggccatatgacagcggagcattactggtaa

SEQ ID NO: 241 - protein, 248 aa, Escherichia coli
MADWVTGKVTKVQNWTDALFSLTVHAPVLPFTAGQFTKLGLEIDGERVQRAYSYVNSPDNPDLEFYLVTVPDGKLSPRLAALKPGDEVQVVSEAAGFFVLDEVPHCETLWMLATGTAIGPYLSILQLGKDLDRFKNLVLVHAARYAADLSYLPLMQELEKRYEGKLRIQTVVSRETAAGSLTGRIPALIESGELESTIGLPMNKETSHVMLCGNPQMVRDTQQLLKETRQMTKHLRRRPGHMTAEHYW

SEQ ID NO: 242 - DNA, 999 bp, Bacillus subtilis
  CDS (1)..(999): YumC gene_B. subtilis encoding a flavodoxin/ferredoxin reductase
atgcgagaggatacaaaggtttatgatattacaattataggcgggggaccggtcggcttattcaccgctttttacggcgggatgagacaggcaagcgtcaaaattatcgaaagcctgcctcagctcggcggacagcttagcgccctataccctgagaagtatatatatgatgtagcgggattcccgaaaatccgcgcgcaagagcttatcaataacctaaaagagcaaatggcgaaattcgaccaaaccatttgtctggagcaagcggttgaatctgttgagaaacaagcggacggcgtgtttaagcttgtaacaaatgaagaaacccactactctaaaacggtcatcataactgcaggaaacggcgcattcaaaccgagaaagctggaacttgaaaatgccgagcagtatgaaggcaaaaacctccattacttcgttgatgatctgcaaaaattcgccggcagacgcgttgcgatccttggcggtggagattccgcggttgactgggcgcttatgcttgagccaatcgcaaaagaagtatcgatcattcaccgccgcgacaagttccgagcgcacgagcacagtgtggaaaaccttcatgcgtcgaaggttaatgtcctgacaccattcgtccctgcggagctgatcggcgaagacaaaatcgaacagctagtgcttgaagaagtgaaaggcgaccgcaaagagattttagaaattgatgacttaatcgtcaactacggtttcgtttcatctcttggaccgatcaaaaactggggcctggacatcgagaaaaattccattgtcgtgaaatcaacaatggaaacaaatatcgaaggcttctttgcagcaggtgacatttgtacatacgaaggaaaagtcaacctgattgccagcggcttcggcgaggcaccgacagcagtgaacaacgccaaggcttacatggacccgaaagcccgcgtacagcctcttcactcaacaagtctttttgaaaataaataa

SEQ ID NO: 243 - protein, 332 aa, Bacillus subtilis
MREDTKVYDITIIGGGPVGLFTAFYGGMRQASVKIIESLPQLGGQLSALYPEKYIYDVAGFPKIRAQELINNLKEQMAKFDQTICLEQAVESVEKQADGVFKLVTNEETHYSKTVIITAGNGAFKPRKLELENAEQYEGKNLHYFVDDLQKFAGRRVAILGGGDSAVDWALMLEPIAKEVSIIHRRDKFRAHEHSVENLHASKVNVLTPFVPAELIGEDKIEQLVLEEVKGDRKEILEIDDLIVNYGFVSSLGPIKNWGLDIEKNSIVVKSTMETNIEGFFAAGDICTYEGKVNLIASGFGEAPTAVNNAKAYMDPKARVQPLHSTSLFENK

SEQ ID NO: 244 - DNA, 780 bp, Pseudomonas pudita
  CDS (1)..(780): fpr-1 gene from Pseudomonas putida KT2440 encoding a flavodoxin/ferredoxin reductase
atgagcaacatgaaccacgaacgtgtcctcagtgtgcaccactggaacgacaccctgttcagcttcaagtgcacccgcgacccgggcctgcgcttcgagaacggtcagttcgtgatgatcggcctgcagcaggacaacggccgtccgctcatgcgtgcctactccatcgcttcgccaaactgggaagagcaccttgaattcttcagcatcaaggtgccggacggcccgctgacctcgcagctgcagcacctgaaggaaggcgatgagatcatcatcagcaagaagcctaccggcaccctggtcctcgacgacctgaatcctggcaagcacctgtacctgctgagcaccggcactggtctggcgccgttcatgagcgtcatccaggacccggaaacctacgagcgctttgaaaaagtgatcctggtgcacggcgtgcgctatgtgaacgaagtggcctaccgcgagttcatcaccgagcacctgccgcagaacgagttcttcggtgagtcggttcgcgacaagctgatctactacccgaccgtgacccgcgagccgttcgaaaaccagggccgtctgaccgacctgatgcgcagcggcaagctgttcagcgacatcggcctgccgccgatcaacccgcaagacgaccgcgcgatgatctgcggcagcccgagcatgctcgacgagaccagcgaagtgctggacagcttcggcctgaagatctccccgcgcatgcgcgagccgggtgactacctgatcgaacgtgccttcgtcgagaagtaa

SEQ ID NO: 245 - protein, 259 aa, Pseudomonas pudita
MSNMNHERVLSVHHWNDTLFSFKCTRDPGLRFENGQFVMIGLQQDNGRPLMRAYSIASPNWEEHLEFFSIKVPDGPLTSQLQHLKEGDEIIISKKPTGTLVLDDLNPGKHLYLLSTGTGLAPFMSVIQDPETYERFEKVILVHGVRYVNEVAYREFITEHLPQNEFFGESVRDKLIYYPTVTREPFENQGRLTDLMRSGKLFSDIGLPPINPQDDRAMICGSPSMLDETSEVLDSFGLKISPRMREPGDYLIERAFVEK

SEQ ID NO: 246 - DNA, 936 bp, Streptomyces venezuelae
  CDS (1)..(936): SVEN_0113 gene from Streptomyces venezuelae encoding a flavodoxin/ferredoxin reductase
atgagcgagaacccgctgcaactgatcgtccaccgcatgacacgggaggccgagggcgtactgtccgtcgaactcgcccaccccgacggcaagccgctgcccgcctggacgccgggcgcccacatcgacgtccacgtcgggggccacgtccgccagtacagcctgtgcggcgacccgcacgaccagggcgcgtaccggatcggcgtcctcgacgaacccgcctcacgcggcggttcgcgcttcgtgcacaccgcactgcgccccggccagaccctcacggtctccgcaccccgcaaccacttcgccctcgaggacgccgccgcgtacgtcctcgtcgccggcggcatcggcatcacgcccctgctcgccatggcccgcgaggcggcccgccggggcgccgagtggcgcctggtctacggcggccggagccgggcgtcgatggccttcaccgccgaactggccctgctcggcggcgaggtgaccctcgtcccgcaggacgaacgcggccacatcgacctggacgccgagctgtcccggctgcccgacggcgccctcgtctacgcctgcggcccggaacccctcctcgcggccgtcgaggaacgctgtccgcaaggacagctgcgcaccgaacggttcaccgcccccaccgtcgaacgcgcagaagacgacggagagttcgaggtcgagtgccgcacctcgggcctgacgctccgggtcgacgcacactcctcgatcctcgacgccgccgagaacgccgggatcgccgtcgacagctcctgccgcgacggcatctgcggctcctgcgagacccgcgtcctcgaaggcaccccggaccaccgcgacttcctcctcagcgaggcggaacaggccgccggcgccaccatgatgatctgcgtctcgcggtgcgcctccggccggctcgtcctcgacctgtga

SEQ ID NO: 247 - protein, 311 aa, Streptomyces venezuelae
MSENPLQLIVHRMTREAEGVLSVELAHPDGKPLPAWTPGAHIDVHVGGHVRQYSLCGDPHDQGAYRIGVLDEPASRGGSRFVHTALRPGQTLTVSAPRNHFALEDAAAYVLVAGGIGITPLLAMAREAARRGAEWRLVYGGRSRASMAFTAELALLGGEVTLVPQDERGHIDLDAELSRLPDGALVYACGPEPLLAAVEERCPQGQLRTERFTAPTVERAEDDGEFEVECRTSGLTLRVDAHSSILDAAENAGIAVDSSCRDGICGSCETRVLEGTPDHRDFLLSEAEQAAGATMMICVSRCASGRLVLDL

SEQ ID NO: 248 - DNA, 978 bp, Corynebacterium glutamicum
  CDS (1)..(978): Cgl2384 gene from Corynebacterium glutamicum encoding a flavodoxin/ferredoxin reductase
atgaactcgcaatggcaagatgcacatgttgtttccagcgaaatcatcgctgcagacattcggcgaatagaactatccccgaaatttgcgattccagtaaaacccggcgaacatctcaagatcatggtgcccctaaaaactggacaggaaaagagatcgtactccatcgttgacgctcgtcacgacggttcgactctcgccctgagcgtactcaaaaccagaaactcccgtggaggatctgagttcatgcatacgcttcgagctggagacacagttactgtctccaggccgtctcaggattttcctctccgcgtgggtgcgcctgagtatgtacttgttgccggcggaattggaatcacagcgatccgttcaatggcatctttattaaagaaattgggagcgaactaccgcatccatttcgcagcacgcagccttgatgccatggcttacaaagatgagctcgtggcagaacacggcgacaagctgcacctgcatctagattctgaaggcaccaccatcgatgtcccagcattgatcgaaaccttaaacccccacactgagctttatatgtgcggccccatccgcttgatggatgccatccggcgcgcatggaacacccgcggacttgaccccaccaatctgcgtttcgaaacgtttggaaacagtggatggttctccccagaggttttccacatccaagtaccagagctggggcttcacgccacagtcaacaaggatgaaagcatgctggaggctttgcaaaaggctggggcgaatatgatgtttgattgtcgaaaaggcgaatgtggtttgtgccaggttcgcgttctagaagtcgatggccaggttgatcaccgcgatgtgttcttctctgatcgtcaaaaagaatccgacgcaaaggcatgcgcctgcgtgtctcgagtagtctcctccccttcctcgtccccaacctcgaccattacggtcgccctctcctaa

SEQ ID NO: 249 - protein, 325 aa, Corynebacterium glutamicum
MNSQWQDAHVVSSEIIAADIRRIELSPKFAIPVKPGEHLKIMVPLKTGQEKRSYSIVDARHDGSTLALSVLKTRNSRGGSEFMHTLRAGDTVTVSRPSQDFPLRVGAPEYVLVAGGIGITAIRSMASLLKKLGANYRIHFAARSLDAMAYKDELVAEHGDKLHLHLDSEGTTIDVPALIETLNPHTELYMCGPIRLMDAIRRAWNTRGLDPTNLRFETFGNSGWFSPEVFHIQVPELGLHATVNKDESMLEALQKAGANMMFDCRKGECGLCQVRVLEVDGQVDHRDVFFSDRQKESDAKACACVSRVVSSPSSSPTSTITVALS

SEQ ID NO: 250 - DNA, 921 bp, Sphingobacterium sp
  CDS (1)..(921): SJN15614.1 from Sphingobacterium sp. JB170 encoding a flavodoxin/ferredoxin reductase
atgtttggcgatcgcgaggttcgtagatcgtattcctttagtagctcgcctgcagttgttgagccgctagccattaccgtaaaaagagtggataatggggaaatttcccgcctgttgcatcatcgtacacgcgttggggatcttgttgatgttctagccccgcagggattatttacatacgaacctgaccccactacagctcgaacattatttttatttggcgccggcgttggtgttactccgttattttccatcctgaaaactgcgctgtccacagaacccaaaacgaaggttgtcctcatttatagcaacagttcacccgataggacagtttttaaagttgaacttgaacattggcaacaactgtatgccgatcggcttgaaattatatggatttactccaattcaaaaaatctgttaaatgcacacctaaaccgcgagaacttattacgctttgtcaatgaacgcatgcctgaggataacaatgctatatttttcacctgtggtccggtattttacatggacttagtacgcttcacgttactcggtcttggaatccccgacgaggatatccgcaaggagacatttcattttcctgaagaagaagatgatgaagatgagaaagaagacgatccggttgatacgacagcgtacaacatattgctcaggtttcaaggacaagaatacccgttgacaattccatacaacaaaacaatcttgcaggccggactggataataatattaaacttccctattcttgtaaatcggggatgtgtagtacttgtatctcacaatgttccagcgggtccgtccggatggattacaatgaggttctaacagatcgtgaggttgaaaatggccgttgtttgatttgtacttcccacccgttagaagatggtacgacgattgatgtagtttaa

SEQ ID NO: 251 - protein, 306 aa, Sphingobacterium sp
MFGDREVRRSYSFSSSPAVVEPLAITVKRVDNGEISRLLHHRTRVGDLVDVLAPQGLFTYEPDPTTARTLFLFGAGVGVTPLFSILKTALSTEPKTKVVLIYSNSSPDRTVFKVELEHWQQLYADRLEIIWIYSNSKNLLNAHLNRENLLRFVNERMPEDNNAIFFTCGPVFYMDLVRFTLLGLGIPDEDIRKETFHFPEEEDDEDEKEDDPVDTTAYNILLRFQGQEYPLTIPYNKTILQAGLDNNIKLPYSCKSGMCSTCISQCSSGSVRMDYNEVLTDREVENGRCLICTSHPLEDGTTIDVV

SEQ ID NO: 252 - DNA, 3525 bp, Escherichia coli
  CDS (1)..(3525): ydbK gene from E. coli encoding pyruvate-flavodoxin/ferredoxin oxidoreductase
atgattactattgacggtaatggcgcggttgcttcggtcgcatttcgcaccagtgaagttatcgccatctaccctattacccccagttccacgatggcagaacaggctgatgcctgggccggaaacggcttaaagaacgtttggggagacacaccacgcgtggttgaaatgcagtcggaagcgggtgctatcgctaccgtgcatggcgctttgcagacgggtgccctttcaacatcgtttacgtcatcgcagggtttgctgctgatgatcccgacgctgtacaaactggcaggcgaactaacaccgtttgtcctgcatgtagcggcacgtaccgttgccacacatgcactctctatttttggcgatcattccgacgttatggcggtgcgccagacgggttgcgcgatgttgtgtgcagcaaacgtccaggaagcgcaagactttgctctcatttcgcaaatcgcgacgctgaaaagccgcgtgccatttattcatttctttgatggtttccgcacgtcccacgaaatcaataaaattgtcccgctggccgatgacacgattcttgatctcatgccgcaggtcgaaattgatgctcatcgcgcccgggcactcaacccggaacatccggtgatccgcggtacgtccgccaatcctgacacttatttccagtctcgcgaagccaccaacccatggtacaacgcggtctatgaccatgttgaacaggcgatgaatgatttctctgccgcgacaggtcgtcagtatcagccgtttgaatattacgggcatccgcaagcggaacgggtgattatcctgatgggctctgccattggcacctgtgaagaagtggttgatgaattgctaacccgtggcgaaaaagttggcgtgctgaaagttcgcctgtaccgccccttctccgctaaacatttactgcaagctctgccgggatccgtacgcagcgtggcggtactggacagaaccaaagaacccggtgcccaggcagaaccgctctatctggatgtaatgaccgcactggcagaagcctttaataatggcgagcgcgaaactctgccccgtgtcattggtgggcgctatggtctttcatccaaagaatttggcccagactgtgtactggcggtatttgccgagctcaacgcggctaaaccgaaagcgcgctttacggttggtatttacgatgatgtgaccaatctgtcactgccgttgccggaaaacaccctgccaaactcggcgaaactggaagccttgttttatggccttggtagtgatggcagcgtttccgcgaccaaaaacaatatcaagattatcggtaattccacgccgtggtacgcacagggctattttgtttacgactccaaaaaggcgggcggcctgacggtttctcaccttcgagtgagcgaacagccgattcgttccgcttatctcatttcccaggctgattttgttggctgccaccagttgcagtttatcgataaatatcagatggctgagcgtttaaaacctggcggcattttcctgctcaacacgccgtacagcgcagatgaagtgtggtcgcgcttgccgcaagaagttcaggccgtgttaaaccagaaaaaagcgcgcttctatgtgattaacgcggcgaaaatcgcccgcgaatgtggcctggcggcccgtattaataccgtcatgcagatggcttttttccatctgacgcaaattctgcctggcgatagcgccctcgcagaattgcagggtgcgattgccaaaagttacagtagcaaaggccaggatctggtggaacgcaactggcaggctctggcgctggcgcgtgaatccgtagaagaagttccgttgcaaccggtaaatccgcacagcgccaatcgaccgccagtggtttccgatgccgcccctgatttcgtgaaaaccgtaaccgctgcgatgctcgccgggcttggtgacgccctccccgtttcggcgctgccgccagacggcacctggccgatgggcactacgcgctgggaaaaacgcaatatcgccgaagagatccccatctggaaagaggaactctgtacccaatgtaaccactgcgttgccgcttgcccacactcagctattcgcgcaaaagtggtgccgcctgaagcgatggaaaacgcccctgccagcctgcattcgctggatgtgaaatcgcgtgatatgcgcgggcagaaatatgtcttgcaggtggcaccggaagattgcaccggttgtaacctgtgcgtcgaagtttgcccggcgaaagaccgtcagaatccagagattaaagccatcaatatgatgtctcgcctggaacatgtcgaagaagagaaaatcaattacgatttcttcctcaacctgccagaaatcgaccgtagcaaactggaacgtattgatattcgtacatcgcagctgattacaccgctgtttgaatattcaggtgcttgctccggttgtggcgagacgccgtatattaaattactgactcagctctatggcgaccggatgttgatcgctaacgccactggctgttcttcaatttatggcggtaacctgccctctacaccgtataccaccgatgccaacggtcgtgggccggcatgggcgaactctctatttgaagataatgccgaatttggccttggtttccgcctgacggtcgatcaacaccgtgtccgcgtgctgcgtctgctggatcaatttgccgataaaatcccggcggaattactgacggcgttgaaatcagacgccacgccagaggttcgtcgtgaacaggttgcagctttacgccagcaactcaacgatgttgccgaagcacatgaactgctacgtgatgcagatgcactggtggaaaaatcaatctggctgattggtggtgatggctgggcttacgatatcggctttggcggtctggatcatgtattgagtttgacggaaaacgtcaacattctggtgctggatacgcaatgctattccaacaccggtggtcaggcgtcgaaagcgacaccgctgggtgcagtaactaaatttggcgagcacggcaaacgtaaagcgcgtaaagatcttggcgtcagtatgatgatgtacggtcatgtttatgtggcgcagatttctctcggcgcgcagctgaaccagacggtgaaagcgattcaggaagcggaagcgtatccggggccatcgctgatcattgcttatagcccgtgtgaagagcatggttacgatctggcactcagccacgaccagatgcgccaactcacagctaccggcttctggccgctatatcgctttgatccgcgtcgtgccgatgaaggcaaactgccgctggccttggattcacgcccgccgtcagaagcaccggaagaaacgttacttcacgagcaacgtttccgtcggctgaattcgcagcagccagaagtggcagaacagttatggaaagatgctgcagctgatttgcaaaaacgctatgacttcctggcacaaatggccggaaaagcggaaaaaagcaacaccgattaa

SEQ ID NO: 253 - protein, 1174 aa, Escherichia coli
MITIDGNGAVASVAFRTSEVIAIYPITPSSTMAEQADAWAGNGLKNVWGDTPRVVEMQSEAGAIATVHGALQTGALSTSFTSSQGLLLMIPTLYKLAGELTPFVLHVAARTVATHALSIFGDHSDVMAVRQTGCAMLCAANVQEAQDFALISQIATLKSRVPFIHFFDGFRTSHEINKIVPLADDTILDLMPQVEIDAHRARALNPEHPVIRGTSANPDTYFQSREATNPWYNAVYDHVEQAMNDFSAATGRQYQPFEYYGHPQAERVIILMGSAIGTCEEVVDELLTRGEKVGVLKVRLYRPFSAKHLLQALPGSVRSVAVLDRTKEPGAQAEPLYLDVMTALAEAFNNGERETLPRVIGGRYGLSSKEFGPDCVLAVFAELNAAKPKARFTVGIYDDVTNLSLPLPENTLPNSAKLEALFYGLGSDGSVSATKNNIKIIGNSTPWYAQGYFVYDSKKAGGLTVSHLRVSEQPIRSAYLISQADFVGCHQLQFIDKYQMAERLKPGGIFLLNTPYSADEVWSRLPQEVQAVLNQKKARFYVINAAKIARECGLAARINTVMQMAFFHLTQILPGDSALAELQGAIAKSYSSKGQDLVERNWQALALARESVEEVPLQPVNPHSANRPPVVSDAAPDFVKTVTAAMLAGLGDALPVSALPPDGTWPMGTTRWEKRNIAEEIPIWKEELCTQCNHCVAACPHSAIRAKVVPPEAMENAPASLHSLDVKSRDMRGQKYVLQVAPEDCTGCNLCVEVCPAKDRQNPEIKAINMMSRLEHVEEEKINYDFFLNLPEIDRSKLERIDIRTSQLITPLFEYSGACSGCGETPYIKLLTQLYGDRMLIANATGCSSIYGGNLPSTPYTTDANGRGPAWANSLFEDNAEFGLGFRLTVDQHRVRVLRLLDQFADKIPAELLTALKSDATPEVRREQVAALRQQLNDVAEAHELLRDADALVEKSIWLIGGDGWAYDIGFGGLDHVLSLTENVNILVLDTQCYSNTGGQASKATPLGAVTKFGEHGKRKARKDLGVSMMMYGHVYVAQISLGAQLNQTVKAIQEAEAYPGPSLIIAYSPCEEHGYDLALSHDQMRQLTATGFWPLYRFDPRRADEGKLPLALDSRPPSEAPEETLLHEQRFRRLNSQQPEVAEQLWKDAAADLQKRYDFLAQMAGKAEKSNTD

SEQ ID NO: 254 - DNA, 3588 bp, Geobacter sulfurreducens
  CDS (1)..(3588): por gene from Geobacter sulfurreducens AM-1 encoding pyruvate-flavodoxin/ferredoxin oxidoreductase
atgagtcgcaaaatggtaaccatcgacggcaataccgcggctgcccacgtggcgcacgccaccaacgaggtcattgccatctaccccattaccccttcgtcggtcatgggtgagatttccgacatcaagagcgccatgggcgagaaaaacatctggggaaccgtaccgtcggttgtcgagatgcagtcggaaggcggcgctgccggtgccgtgcacggtgccctccaggcaggtgcgctgaccaccacttttaccgccagccagggtctgctcctgatgatcccgaacatgttcaagatcgccggcgagctgacctctacggtcttccatgtctccgcccgcgccatcgcggcccaggccctctccatctttggcgaccattcggacgtcatgtcctgccgttccaccggttgggccatgctctgctccaacaactcccaggaggtcatggacttcgccctgattgcccagtccgcgacgcttcgttcccgggtgccgttcctccatttcttcgacggcttccggacctcccacgaggttctcaaggtggaggagctgactttcgacgacatgcgcgccatgctggacgacgaactgatcgccgcccacaaggcccggggcctctctccggaccatcccgtcatgcgcggcaccgcccagaaccctgacgtctacttccaggggcgcgagaccgttaaccccttctacccgaaatgcatcgagatcgtggcagaggagatggacaagttcgccaagatcacgggccgccagtacaagctggtggactacgtgggcgcccccgacgccgaccgggtcatcgtcatcatgggatccggcgccgacacggtgcaggagaccgtggagcacctgaacaccaagggtgagaagatcggcgtggtgaaggtccacctctaccggccgttccccatcgatgccttcattgccgccctgcccaagaccgtgaagaagatcgcggtcctcgaccggaccaaggagcccggcgccctgggcgagcccctgtacctggatgtccgcactgccatcggcgaggccatggccgacgggaagtgccagttcgacggctacccggtcatcgtgggcggtcgctacggccttggttccaaggagttcaccccggcccaggccaaggcggtgttcgataacctagccactgccaagccgcagaacaagttcgtggtcggcatcaccgaggacgtgaccaacagcagcctcccgtgtgatccgtccttcttcaacccgatggaaggggcctaccaggccatgttcttcggcctcggctccgacggtaccgtgggcgccaacaagaactccatcaagatcatcggcgagatgaccgataacaacgcccaggcctacttcgtctacgactccaagaaggccggctccatgaccacctcgcacctgcgcttcggcaagaagtacatcagagcgccgtacctggtgcaggaggccgacttcgtggcctgccacaacttcgccttcgtggaaaagtacgacatgctggccaaggccaagcagggtgccacgttcctcctgaacgccccttacgaccacaacgaggtgtgggacaggctccccgccgacatgcagcagcagatcatcgacaagaagctcaagttcttcgtgatcgatggggtacgcctcggcaacgagatcgggctcggtccccggatcaacgtgatcatgcagaccgccttcttcaagatatccaacatcatcccgctggatcaggccattgacgagatcaaggacgctatcaagaaaacctatggcaaggcaggcgagaaggtcgtggagatgaactacaaggcggttgaggccggcctcaacaacttctacgaggtaacggtaccggcaacggcaaccagtaccctccagaagcctcccgtggtcagcgccagggccccccagttcgtgcaggagaccaccgcccccatcatcgccggcctcggcgacgacctgccggtgtccaagatgccggccgacggcaccttcccgacggcgacctcccagttcgaaaagcggaacatcgccgtggagatccccgtgtgggacgagcagctctgcatccagtgcggcatctgctccttcgtctgcccccacgccaccatcaggatgaaggcctatgacgcctccgcccttgccggcgccccggcagcgttcaagtcggttgactgcaagattcccgagttcaaggggcagaagttcaccatccaggtagccccggaagactgcaccggctgcggcgcctgcgtccacaactgcccggccaagagtaaggaagacccgaaccacaaggccatcaatatggcataccagccgcccctgcgttctcaagaggtcgagaactgggacttcttcctcaccatcccggacgtggaccccaccgtagccaagctggacacggtccgcggttcccagttggtgcggccgctgttcgaattctccggcgcctgcctcggctgcggcgagaccccgtacctgaagctcctgacccagctcttcggcgaccggaccgtcattgccaacgccaccggctgctcctccatctacggcggaaacctgcccaccaccccctatgcccagcgggccgacgggcttgggccggcatggtcgaactccctgttcgaggacaacgccgagttcggctacggcatgcgtctggccgtggataaattcaacgccatggcccttgagctggtcgacaagctttcgtcttcctgctcctgctcttcctgcacgagcgcggtgcccctcatgaacgagatcaagggcgccgaccagtcgagccaggccggcatcgaggcccagcgggcccgggtggcggagctgaagaagacccttgcttcctgtcccgagccggatgccaagcgcctgctcaccgtggccgactacctggtcaagaagtccgtctggtgcatcggcggcgacggctgggcgtacgatatcggctacggcggcctcgaccacgtcatcgccagcggcaagaacatcaatctgctggtgctcgacaccgaggtctactccaacaccggcggccaggcttccaagtcgaccccgctgggcgccgtggcccagttcgccgccggcggtaagccggtctccaagaaggatctcggcatgatggccatggcctacgggtcggtctacgtggccactgtctccctcgccaatccggcccagtgcatcaaggcgttcctggaggccgaggcctatgacggtccgtcgctcatcatcgcctatgcccactgcatcgcccacggcatcgacatgaccagcggcgtggatgcccagaagcgggcggttcagtccggttactggcccctctaccgctataatccgcagctggccgccgagtgcaagaacccgctccagctcgacagcaaggccccgaccatcgcctttgaagagtacgtcaacagcgagaaccgctaccgcgtcctcaagaagaacaacccgaaagggtacgaggatctcatgagaaaagcggcggcatggtccaaggcccacttcagctactaccagaagctggcggccctcaacttcgaggatacctgcgagaagtag

SEQ ID NO: 255 - protein, 1195 aa, Geobacter sulfurreducens
MSRKMVTIDGNTAAAHVAHATNEVIAIYPITPSSVMGEISDIKSAMGEKNIWGTVPSVVEMQSEGGAAGAVHGALQAGALTTTFTASQGLLLMIPNMFKIAGELTSTVFHVSARAIAAQALSIFGDHSDVMSCRSTGWAMLCSNNSQEVMDFALIAQSATLRSRVPFLHFFDGFRTSHEVLKVEELTFDDMRAMLDDELIAAHKARGLSPDHPVMRGTAQNPDVYFQGRETVNPFYPKCIEIVAEEMDKFAKITGRQYKLVDYVGAPDADRVIVIMGSGADTVQETVEHLNTKGEKIGVVKVHLYRPFPIDAFIAALPKTVKKIAVLDRTKEPGALGEPLYLDVRTAIGEAMADGKCQFDGYPVIVGGRYGLGSKEFTPAQAKAVFDNLATAKPQNKFVVGITEDVTNSSLPCDPSFFNPMEGAYQAMFFGLGSDGTVGANKNSIKIIGEMTDNNAQAYFVYDSKKAGSMTTSHLRFGKKYIRAPYLVQEADFVACHNFAFVEKYDMLAKAKQGATFLLNAPYDHNEVWDRLPADMQQQIIDKKLKFFVIDGVRLGNEIGLGPRINVIMQTAFFKISNIIPLDQAIDEIKDAIKKTYGKAGEKVVEMNYKAVEAGLNNFYEVTVPATATSTLQKPPVVSARAPQFVQETTAPIIAGLGDDLPVSKMPADGTFPTATSQFEKRNIAVEIPVWDEQLCIQCGICSFVCPHATIRMKAYDASALAGAPAAFKSVDCKIPEFKGQKFTIQVAPEDCTGCGACVHNCPAKSKEDPNHKAINMAYQPPLRSQEVENWDFFLTIPDVDPTVAKLDTVRGSQLVRPLFEFSGACLGCGETPYLKLLTQLFGDRTVIANATGCSSIYGGNLPTTPYAQRADGLGPAWSNSLFEDNAEFGYGMRLAVDKFNAMALELVDKLSSSCSCSSCTSAVPLMNEIKGADQSSQAGIEAQRARVAELKKTLASCPEPDAKRLLTVADYLVKKSVWCIGGDGWAYDIGYGGLDHVIASGKNINLLVLDTEVYSNTGGQASKSTPLGAVAQFAAGGKPVSKKDLGMMAMAYGSVYVATVSLANPAQCIKAFLEAEAYDGPSLIIAYAHCIAHGIDMTSGVDAQKRAVQSGYWPLYRYNPQLAAECKNPLQLDSKAPTIAFEEYVNSENRYRVLKKNNPKGYEDLMRKAAAWSKAHFSYYQKLAALNFEDTCEK

SEQ ID NO: 256 - DNA, 1956 bp, Streptomyces pratensis
  CDS (1)..(1956): Sfla_2592 gene from Streptomyces pratensis ATCC 33331encoding pyruvate-flavodoxin/ferredoxin oxidoreductase
atgaccagccaggtcagtagcccagccggaaagtccgatgaggccagcgaggctgtcgtcggggaacagcgcgccccgcacatcgccggtgcgggtggcacggagaaggaaatccgccgtctggaccgggtgatcatccgtttcgcgggtgactcgggtgacggtatgcagttgacgggcgaccgtttcacgtcggagacggcgtcgttcgggaacgacctgtcgacactgcccaacttcccggccgagatccgggcacccgccggcaccctgcccggggtgtcgtcgttccagctgcatttcgcggaccacgacatcctgacaccgggcgacgcgccgaacgtcctggtcgcgatgaatcccgccgcgctgaaggcgaatatcgccgatgtgccgcgcggggccgacatcatcgtgaacacggacgagttcacgaagcgcccgatggcgaaagtcggatatgcggaatcccctttggaggacggttccctcgaggcgtacaacgtgcatccggtgccgttgacgacgttgacgatcgaggctttgaaggagttcgggctttcccgcaaggaggccgagcggtcgaagaacatgttcgcgctcgggcttctgtcctggatgtacaaccgtccgaccgagggtacggagaagttcctgcggtcgaagttcgccaggaagccggagatcgccgaggccaatgtggcggctttccgcgcgggctggaatttcggtgagacgacggaggatttcgctgtctcctacgaggtcgcaccggcgtcacaggatttcccgacgggcacctaccgcaatatctccgggaatctcgcactgtcgtacgggctgatcgcggcgggacggcaggccgatctgccggtgtatctcggctcgtatccgatcactccggcgtccgacatcctgcacgagctcagcaagcacaagaacttcggtgtgcggaccttccaggcggaggacgagatcgccgggatcggtgcggccctgggcgcgtcgttcggcggttcactgggtgtgacgacgacgtcgggcccgggtgtggcgctgaagtcggagacgatcggcctggcggtgtcactggaactgccgctgctgatcatcgacatccagcgcggcggcccctccaccggcctgccgaccaagaccgagcaggccgacctgctccaggccatgtacgggcgcaacggcgaggccccggtcccgatcgtggcaccgaggactccggcggactgcttcgacgccgccctggacgcggcgcggatcgcgctgacctaccgcaccccggtcttcctgctctcggacgggtacctcgcgaacggctccgagccgtggcggatccccgaggccgacagcctccccgacctgcggacacggttcgcgaccggcccgaatcacgaactcgcggacggcaccgaggtgttctggccctacaagagggaccccgagacgctggcccgcccgtgggcggtgcccggcaccccgggtctggagcaccggatcggcgggatcgagaagcaggacggcacggggaacatctcctacgatccggccaaccacgacttcatggtccgcacccgccaggccaagatcgacggcatccgggtccccgacctggaggtcgacgacccggccggcgcgacgaccctggtcctgggctggggttcgacgtacgggccgatcaccgccgccgtgcgccgtctccgcgcggccggcgagacgatcgcacaggcacatctgcgccacctcaatcccttccccgccaatctcggtgaggtactgcggcgctacgacaaggtcgtcgtccccgagatgaacctcggtcagctcgccctgctgctgagagccaagtacctcgtggacgcgcagagtttcaaccaggtcaacggaatgcccttcaaggcggagcagctcgccacagccctcaaggaggccatcgatgcctga

SEQ ID NO: 257 - protein, 651 aa, Streptomyces pratensis
MTSQVSSPAGKSDEASEAVVGEQRAPHIAGAGGTEKEIRRLDRVIIRFAGDSGDGMQLTGDRFTSETASFGNDLSTLPNFPAEIRAPAGTLPGVSSFQLHFADHDILTPGDAPNVLVAMNPAALKANIADVPRGADIIVNTDEFTKRPMAKVGYAESPLEDGSLEAYNVHPVPLTTLTIEALKEFGLSRKEAERSKNMFALGLLSWMYNRPTEGTEKFLRSKFARKPEIAEANVAAFRAGWNFGETTEDFAVSYEVAPASQDFPTGTYRNISGNLALSYGLIAAGRQADLPVYLGSYPITPASDILHELSKHKNFGVRTFQAEDEIAGIGAALGASFGGSLGVTTTSGPGVALKSETIGLAVSLELPLLIIDIQRGGPSTGLPTKTEQADLLQAMYGRNGEAPVPIVAPRTPADCFDAALDAARIALTYRTPVFLLSDGYLANGSEPWRIPEADSLPDLRTRFATGPNHELADGTEVFWPYKRDPETLARPWAVPGTPGLEHRIGGIEKQDGTGNISYDPANHDFMVRTRQAKIDGIRVPDLEVDDPAGATTLVLGWGSTYGPITAAVRRLRAAGETIAQAHLRHLNPFPANLGEVLRRYDKVVVPEMNLGQLALLLRAKYLVDAQSFNQVNGMPFKAEQLATALKEAIDA

SEQ ID NO: 258 - DNA, 3768 bp, Propionibacterium freudenreichii
  CDS (1)..(3768): RM25_0186 gene from Propionibacterium freudenreichii DSM 20271encoding pyruvate-flavodoxin/ferredoxin oxidoreductase
atgactacaactacccgtgggccggttcccggctcgaatggcatgcccgccaatccaggtctgagcggcgaggccgccaccgcaaccccgtcacccgttgacgtcgctgccggcgccaaggacgctgccgatgagctggcccagtcacgacgcgagcaggacatcacccatcagatgatctgcgacggcaacaccgccgcctctgatgtggccttccgcatcaatgagctgtgctcgatctacccgatcacgccgagctccccgatggccgaactggccgacgagtggagtgcccgcgaccgcatgaacatctggggccaggtgccccatgtgatggagatgcagtcggaggccggcgcggccggtgccatgcacggctccctgcagggcggcgccctggcgaccaccttcacggcgtcgcagggcctgctgctgatgatcccgaacatgtacaagatcgccggtgagctcacctccacggtgatgcacgtcgccgcgcgctcgctggccacccagggcctgtcgatcttcggtgatcaccaggacgtgatggcctgtcgccagaccggttgggcgatgctgtgctccaccggcgtgcagcagtgccatgacaatgccctgatctcccaggtcgccacgctgcgttcgcgcgtgccgttcatgcacttcttcgacggcttccgcaccagccatgagctcaacacctgcatccagctcaccgacgaccagctgcgttcgatggtgcccgatgcgctcgtgcgcgagcaccgcgagcgggccctgtcgcccgacaacccgttcatccgtggcaccgcccagaacgccgacgtgtacttccagggccgcgaggccggcaacaagtactacgactcggttccgggcatcgtgcaggacgcgatggacgagttcgccgccatgaccggccgccagtaccacctggccgactactacggcgcgcccgacgccgatcgcgtcatcgtgatcatgggctcgggtgccgagaccgtgcagcagaccgtcagcaagctcaatgagcagggcgagaaggtcggcctggtggtcatccgcctgtaccgtccgttcccgacgcaggccgtgctggactgcattcccgcatcggtcaagaagatcgccgtgctcgaccgcaccaaggagccgggctccaacggtgagcccctgttcctcgacgtggtctcggcagtctccgaggcctattcgaacggcgagcgcgacaacctgcccgccatcatcggtggccgctacggcctgtcgagcaaggagttcacgccgggcatgtgcgccgccgtgtacgacgagctcgccaaggacaagccgaagcgtcgcttcaccgtcggcatcaccgacgatgtgacgcacctgtcgatcccgtgggacgcctcgctcgacctggaggaccccgagacctcgcgcgcagtgttctacggcatcggtgctgacggcaccgtcggcgccaacaagaacaccatcaagatcctcggctccgagccgggcacctacgcgcagggctacttcgtctacgactcgaagaagtccggcggccgcaccacctcgcaccttcgcttcggacccgatccgatcaaggccccctacctggtgaaccaggccggcttcatcggcgtgcaccactgggccgaccttgagcgcatcgacgtgctggcgttcgcccgcaagggcaccacggtgctgatcaacagcccgtaccccgccgaggacgtctggggccatctgccggccccgatgcagaagaagatcatcgacctcgacctgcaggtgtatgcgatcgacgccggtgaggtggcccgttcggtgggcctgggcaaccgcaccaacacggtgctgcagacctgctacttcaagatcagtggcgtgcttcccgaggaccacgcgatcgaggccatcaagaactcgatcaccaagacctacgcgaagaagtcgatggagatcgtggagaagaaccacgccgccgtcgacgccgccctggagcacctgcacaagatcgacgtgccggccaaggtcacctccaccgaggactacctgccgcccgtgccgtcgttcgcgcctgacttcgtcaaggacgtcaccgcggccatgatgaccgagcagggcgagtcgctgccggtgagcaagctgccggccgatggttcgttcccctcgggcaccacgcagtacgagaagcgcaatgtgtccgagatcatcgcggtctgggaccaggacaactgcatccagtgcggcaactgcgccttcgtctgcccgcacggcgtgctgagggccaagtactacaagcccgatgtgctcgacgatgcgccgaagtcgttccaggcggttccgctgaatgcggccggcctgcccgacgagatgtacaccctgcaggtgttcgccgaggactgcaccggttgtggcctgtgcgtcgaggcctgccccgtgcatcccatcggtggcgaccccgaatgcaaggcgatcaacctggattccgtgctcgaccgcaccaacgagcgggcgaacgtggagttcttccagaagatccccgagcccccgcgcacccgcgtgaactacggtgccgtgcgtggcgcccagttcctgcagccgctgttcgagttcagcggtgcctgcccgggttgtggcgagacgccgtacctcaagctgctcacccagctgttcggcgaccgcgccaccgtggcgaatgccaccggctgctcgtccatctacggcggcaacctgccgaccaccccgtgggcgaagaacaaggagggacgcggcccggcctggagcaactcattgttcgaggacaacgccgagttcggccttggcatgcgcctggcggccgacctgcacaacgaactggcccgtcagcgcgttgacgagctgtccgatgcgatcaacgaccccgagctggtcgatcagctgctgaacgccccgcaggcgcaggagtccgatctgcacgcccaggccgagcgcgtcgacgccctgcaggatcgcctgaccgacctggtcaacgatccgaacgtggacgccgacaccaaggccaaggtcgaggacctgcggtcggtggccgacaacctgctgcgtcgttccgtgtggatcgtcggcggcgacggttgggcctacgacatcggttcgggcggccttgaccatgtgctgtccaccggacgcaatgtcaatgtgctggtgctcgacaccgaggtctactccaataccggtggccaggcctcgaagtcgtcgcccatgggtgcgatcgcgaagttcgcgaccgccggcaagcgcacgaacaagaaggacatcgccatgcaggccgtgtcctacggcgacgtctatgtcgcccgcgtggcgttcggtgccgacccggagcagacgctgaaggcattccgtgaggccgaggcctaccccggccccagcctgatcatcgcctacagccactgcatcagccatggctacaacctgcgcaagggcctggaccagcagtacaaggcagtggcctccggtcactggccgctgatccggtacaacccggaggttcgcgactcgggtggcaacccgttcctgctcgactcggcccgtccgcgcatctcgctgatggactaccgcaagaccgagctgcgcttcaagatgctgatggtcaaggatccggaagaggccaagcacctcaatgacctcagccaggagcaggtgaccaggcgtttcgccgactacgaggaaatggcctcacgtccggccgagatgttcgccaccgacgcacggagggatgtctga

SEQ ID NO: 259 - protein, 1255 aa, Propionibacterium freudenreichii
MTTTTRGPVPGSNGMPANPGLSGEAATATPSPVDVAAGAKDAADELAQSRREQDITHQMICDGNTAASDVAFRINELCSIYPITPSSPMAELADEWSARDRMNIWGQVPHVMEMQSEAGAAGAMHGSLQGGALATTFTASQGLLLMIPNMYKIAGELTSTVMHVAARSLATQGLSIFGDHQDVMACRQTGWAMLCSTGVQQCHDNALISQVATLRSRVPFMHFFDGFRTSHELNTCIQLTDDQLRSMVPDALVREHRERALSPDNPFIRGTAQNADVYFQGREAGNKYYDSVPGIVQDAMDEFAAMTGRQYHLADYYGAPDADRVIVIMGSGAETVQQTVSKLNEQGEKVGLVVIRLYRPFPTQAVLDCIPASVKKIAVLDRTKEPGSNGEPLFLDVVSAVSEAYSNGERDNLPAIIGGRYGLSSKEFTPGMCAAVYDELAKDKPKRRFTVGITDDVTHLSIPWDASLDLEDPETSRAVFYGIGADGTVGANKNTIKILGSEPGTYAQGYFVYDSKKSGGRTTSHLRFGPDPIKAPYLVNQAGFIGVHHWADLERIDVLAFARKGTTVLINSPYPAEDVWGHLPAPMQKKIIDLDLQVYAIDAGEVARSVGLGNRTNTVLQTCYFKISGVLPEDHAIEAIKNSITKTYAKKSMEIVEKNHAAVDAALEHLHKIDVPAKVTSTEDYLPPVPSFAPDFVKDVTAAMMTEQGESLPVSKLPADGSFPSGTTQYEKRNVSEIIAVWDQDNCIQCGNCAFVCPHGVLRAKYYKPDVLDDAPKSFQAVPLNAAGLPDEMYTLQVFAEDCTGCGLCVEACPVHPIGGDPECKAINLDSVLDRTNERANVEFFQKIPEPPRTRVNYGAVRGAQFLQPLFEFSGACPGCGETPYLKLLTQLFGDRATVANATGCSSIYGGNLPTTPWAKNKEGRGPAWSNSLFEDNAEFGLGMRLAADLHNELARQRVDELSDAINDPELVDQLLNAPQAQESDLHAQAERVDALQDRLTDLVNDPNVDADTKAKVEDLRSVADNLLRRSVWIVGGDGWAYDIGSGGLDHVLSTGRNVNVLVLDTEVYSNTGGQASKSSPMGAIAKFATAGKRTNKKDIAMQAVSYGDVYVARVAFGADPEQTLKAFREAEAYPGPSLIIAYSHCISHGYNLRKGLDQQYKAVASGHWPLIRYNPEVRDSGGNPFLLDSARPRISLMDYRKTELRFKMLMVKDPEEAKHLNDLSQEQVTRRFADYEEMASRPAEMFATDARRDV

SEQ ID NO: 260 - DNA, 3600 bp, Synechocystis PCC6803
  CDS (1)..(3600): nifJ gene from Synechocystis sp. PCC 6803 encoding pyruvate-flavodoxin/ferredoxin oxidoreductase
atgagtttacctacctatgccaccctcgacggtaatgaagcggtggcccgtgtggcctacctgctcagtgaagtgattgccatttatcccatcaccccttcctcgcccatgggggaatggtccgatgcttgggcagcagaacaccggcccaatttgtggggcaccgtaccattggtggtggaaatgcaaagcgaggggggagccgccggtactgtccatggcgctctgcaatcgggagctttgaccacaacatttaccgcttcccagggcttaatgttgatgttgcccaatatgcacaaaattgctggggaattaacagccatggttttgcatgtggcggcccgttctttagcggcccagggcctatctatttttggggatcacagtgatgtgatggcggccagaaatacgggctttgccatgttaagttccaattctgtccaggaagcccacgattttgccctcattgccacggccaccagctttgccaccaggataccgggactgcacttttttgatggttttcgcacttcccacgaagaacaaaaaattgagcttttaccccaggaagtactccgtggtttgattaaggatgaggatgtgctagcccaccggggacgggctttgacccccgatcgcccgaagttgcgggggacggcccaaaatccggatgtctatttccaagctagggaaacggttaatcccttttatgccagttatcccaacgtgctggagcaggtgatggaacaatttggccagctaaccggccgccattaccgtccctatgaatattgtggccatccggaagcggaacgggtgattgtgctgatgggttctggtgcggaaacggcccaggaaacggtggattttctaactgcccaaggggaaaaggttggtttactgaaagtacgcctctatcggccctttgctggcgatcgcctggttaatgctctaccaaaaacggtgcaaaaaatagcggtgctggaccggtgtaaggaaccggggagcattggggaacccctctatcaggatgtgctgacggccttttttgaagcgggcatgatgccgaaaattattggtggccgttacggtctgtcatccaaggaatttacccccgccatggttaaaggggtgttggaccatttaaatcaaaccaaccccaaaaaccatttcaccgtaggcattaacgatgatttgagccacaccagcatcgactatgaccccagtttttccacggaagcagattctgtcgtccgggcaattttctacggtctcggttccgacggtacggtgggggccaataagaactccatcaaaatcattggcgaagatacggataactacgcccagggttattttgtttacgactcgaaaaaatccggttctgtaaccgtttcccatctgcgctttggccctaatcccatcctgtccacttacctgattagccaagccaattttgtcgcctgtcaccagtgggaatttttggaacagtttgaagtcttggaaccagccgttgatggcggcgttttcctggtcaatagcccctacggcccagaggaaatttggcgagagtttccccgcaaagtacaacaggaaattattgacaaaaatctcaaggtttacaccatcaatgccaatgacgtagccagggatgcgggcatgggccgccgcaccaacacagtcatgcaaacctgtttctttgccctagcgggagtgttaccccgggaagaggcgatcgccaaaattaagcagtcggtccaaaaaacctacggcaaaaagggtcaggaaattgtcgagatgaatattaaagcggtggattccaccctggcccatctctatgaagtgtccgtaccggaaacggtgagcgacgatgcccctgctatgcggccggtggtgcctgataacgccccggtgtttgtgcgggaagtgttaggaaaaatcatggcccggcaaggggatgatctcccggtcagtgctttaccctgcgatggcacctatcccaccgccactacccaatgggaaaaacgcaacgtgggccacgaaattcccgtttgggaccccgatgtttgtgtgcaatgcggcaaatgcgtcattgtttgtccccatgctgtgattcggggcaaagtttacgaggaggcagaattggccaatgctccggtcagtttcaaatttaccaatgccaaagaccatgattggcaaggttctaagttcaccatccaggtagccccggaagattgcaccggttgcggcatctgtgtggacgtatgcccggctaaaaataaatcccagcctcgtttaagggcgattaatatggctccccagttacccttgcgggaacaggaacgggagaattgggactttttcctagatttgcccaaccccgatcgcctcagtttgaatttgaacaaaatcagccatcaacagatgcaggagccgttatttgaattttctggagcctgtgccggttgtggggaaaccccttatttgaaactggtcagtcaattatttggcgatcgcatgttagtggccaacgccaccggttgctcttccatctatggcggcaacttaccgacaactccctgggcccaaaatgctgagggtcgcggtcccgcttggtccaattccctgtttgaagataacgctgaatttggccttggtttccgagtggcgatcgacaagcaaacggaatttgcaggggaattgctaaaaacctttgctggggagttgggagacagtttggtaagtgaaattctcaacaatgcccaaaccactgaagcggatatttttgaacaacggcaattggtagaacaggttaagcaacgtttgcaaaatctggaaactccccaagcccaaatgttcctttctgtagcggattacctcgtgaagaaaagcgtttggattattggtggcgatggctgggcctacgacattgggtacggcggtttggatcacgtcctcgccagtgggcgtaatgtcaatatcttggtgatggatacggaagtctattccaacaccgggggccaagcctccaaagccactccccgggccgctgtagctaaattcgccgctgggggtaaaccctctcccaaaaaagatttgggcttaatggccatgacctacggcaacgtctatgtggccagtatcgccatgggagccaaaaatgagcagtccattaaagcctttatggaagcggaagcctatcccggtgtctcgttaattattgcctactcccactgcattgcccacggcattaatatgaccaccgcgatgaaccatcaaaaagagttggtggacagcggtcgttggttgctctaccgctataaccctttgttggcggatgaaggtaaaaatcccctgcaattggatatgggatcgccaaaagtagccattgacaaaacggtctattcggaaaatcgctttgccatgctcacccgcagtcaaccagaggaggccaaacgcttaatgaagttagctcaaggggatgtgaacactcgctgggccatgtacgaatatctggcgaaacgttctctgggtggggaaattaacggtaacaaccatggtgtttccccatctccggaggtaattgctaaatctgtttag

SEQ ID NO: 261 - protein, 1199 aa, Synechocystis PCC6803
MSLPTYATLDGNEAVARVAYLLSEVIAIYPITPSSPMGEWSDAWAAEHRPNLWGTVPLVVEMQSEGGAAGTVHGALQSGALTTTFTASQGLMLMLPNMHKIAGELTAMVLHVAARSLAAQGLSIFGDHSDVMAARNTGFAMLSSNSVQEAHDFALIATATSFATRIPGLHFFDGFRTSHEEQKIELLPQEVLRGLIKDEDVLAHRGRALTPDRPKLRGTAQNPDVYFQARETVNPFYASYPNVLEQVMEQFGQLTGRHYRPYEYCGHPEAERVIVLMGSGAETAQETVDFLTAQGEKVGLLKVRLYRPFAGDRLVNALPKTVQKIAVLDRCKEPGSIGEPLYQDVLTAFFEAGMMPKIIGGRYGLSSKEFTPAMVKGVLDHLNQTNPKNHFTVGINDDLSHTSIDYDPSFSTEADSVVRAIFYGLGSDGTVGANKNSIKIIGEDTDNYAQGYFVYDSKKSGSVTVSHLRFGPNPILSTYLISQANFVACHQWEFLEQFEVLEPAVDGGVFLVNSPYGPEEIWREFPRKVQQEIIDKNLKVYTINANDVARDAGMGRRTNTVMQTCFFALAGVLPREEAIAKIKQSVQKTYGKKGQEIVEMNIKAVDSTLAHLYEVSVPETVSDDAPAMRPVVPDNAPVFVREVLGKIMARQGDDLPVSALPCDGTYPTATTQWEKRNVGHEIPVWDPDVCVQCGKCVIVCPHAVIRGKVYEEAELANAPVSFKFTNAKDHDWQGSKFTIQVAPEDCTGCGICVDVCPAKNKSQPRLRAINMAPQLPLREQERENWDFFLDLPNPDRLSLNLNKISHQQMQEPLFEFSGACAGCGETPYLKLVSQLFGDRMLVANATGCSSIYGGNLPTTPWAQNAEGRGPAWSNSLFEDNAEFGLGFRVAIDKQTEFAGELLKTFAGELGDSLVSEILNNAQTTEADIFEQRQLVEQVKQRLQNLETPQAQMFLSVADYLVKKSVWIIGGDGWAYDIGYGGLDHVLASGRNVNILVMDTEVYSNTGGQASKATPRAAVAKFAAGGKPSPKKDLGLMAMTYGNVYVASIAMGAKNEQSIKAFMEAEAYPGVSLIIAYSHCIAHGINMTTAMNHQKELVDSGRWLLYRYNPLLADEGKNPLQLDMGSPKVAIDKTVYSENRFAMLTRSQPEEAKRLMKLAQGDVNTRWAMYEYLAKRSLGGEINGNNHGVSPSPEVIAKSV

SEQ ID NO: 262 - DNA, 531 bp, Escherichia coli
  CDS (1)..(531): fldA gene from E. coli encoding flavodoxin
atggctatcactggcatctttttcggcagcgacaccggtaataccgaaaatatcgcaaaaatgattcaaaaacagcttggtaaagacgttgccgatgtccatgacattgcaaaaagcagcaaagaagatctggaagcttatgacattctgctgctgggcatcccaacctggtattacggcgaagcgcagtgtgactgggatgacttcttcccgactctcgaagagattgatttcaacggcaaactggttgcgctgtttggttgtggtgaccaggaagattacgccgaatatttctgcgacgcattgggcaccatccgcgacatcattgaaccgcgcggtgcaaccatcgttggtcactggccaactgcgggctatcatttcgaagcatcaaaaggtctggcagatgacgaccactttgtcggtctggctatcgacgaagaccgtcagccggaactgaccgctgaacgtgtagaaaaatgggttaaacagatttctgaagagttgcatctcgacgaaattctcaatgcctga

SEQ ID NO: 263 - protein, 176 aa, Escherichia coli
MAITGIFFGSDTGNTENIAKMIQKQLGKDVADVHDIAKSSKEDLEAYDILLLGIPTWYYGEAQCDWDDFFPTLEEIDFNGKLVALFGCGDQEDYAEYFCDALGTIRDIIEPRGATIVGHWPTAGYHFEASKGLADDDHFVGLAIDEDRQPELTAERVEKWVKQISEELHLDEILNA

SEQ ID NO: 264 - DNA, 522 bp, Escherichia coli
  CDS (1)..(522): fldB gene from E. coli encoding flavodoxin
atgaatatgggtcttttttacggttccagcacctgttacaccgaaatggcggcagaaaaaatccgcgatattatcggcccagaactggtgaccttacataacctcaaggacgactccccgaaattaatggagcagtacgatgtgctcattctgggtatcccgacctgggattttggtgaaatccaggaagactgggaagccgtctgggatcagctcgacgacctgaaccttgaaggtaaaattgttgcgctgtatgggcttggcgatcaactgggatacggcgagtggttcctcgatgcgctcggtatgctgcatgacaaactctcgaccaaaggcgtgaagttcgtcggctactggccaacggaaggatatgaatttaccagcccgaaaccggtgattgctgacgggcaactgttcgtgggtctggcgctggatgaaactaaccagtatgaccttagcgacgagcgtattcagagctggtgcgagcaaatcctcaacgaaatggcagagcattacgcctga

SEQ ID NO: 265 - protein, 173 aa, Escherichia coli
MNMGLFYGSSTCYTEMAAEKIRDIIGPELVTLHNLKDDSPKLMEQYDVLILGIPTWDFGEIQEDWEAVWDQLDDLNLEGKIVALYGLGDQLGYGEWFLDALGMLHDKLSTKGVKFVGYWPTEGYEFTSPKPVIADGQLFVGLALDETNQYDLSDERIQSWCEQILNEMAEHYA

SEQ ID NO: 266 - DNA, 477 bp, Bacillus subtilis
  CDS (1)..(477): ykuN gene from Bacillus subtilis encoding flavodoxin
atggctaaagccttgattacatatgccagcatgtcaggaaatacagaagacattgccttcataataaaagatacgcttcaggaatatgagttggatatcgattgtgtcgagataaatgatatggatgcgtcttgtttaacctcctatgattatgtactgattggcacctatacatggggggacggcgatttgccctacgaagcggaggattttttcgaagaggtcaaacagattcagcttaatggtttaaaaacagcctgcttcgggtctggcgattattcttatccaaagttttgcgaagcggtgaatttgttcaatgtcatgctgcaagaggcgggagctgctgtttaccaggaaacactaaaaattgaattagcgcctgaaacagatgaagatgtggaaagctgccgagcgtttgcgagaggttttcttgcatgggcagattatatgaacaaggaaaaaatccatgtttcataa

SEQ ID NO: 267 - protein, 158 aa, Bacillus subtilis
MAKALITYASMSGNTEDIAFIIKDTLQEYELDIDCVEINDMDASCLTSYDYVLIGTYTWGDGDLPYEAEDFFEEVKQIQLNGLKTACFGSGDYSYPKFCEAVNLFNVMLQEAGAAVYQETLKIELAPETDEDVESCRAFARGFLAWADYMNKEKIHVS

SEQ ID NO: 268 - DNA, 513 bp, Synechocystis PCC6803
  CDS (1)..(513): isiB gene from Synechocystis encoding flavodoxin
atgacaaaaattggacttttttacggtactcaaaccggcaacactgaaaccattgctgaactgattcaaaaagaaatgggcggcgatagtgtggtcgatatgatggatatatcccaggctgatgttgatgattttaggcaatatagttgcctgattatcggttgtcccacctggaatgtgggggaactccagagtgattgggaaggcttttatgaccaattagacgaaattgattttaatggcaaaaaagtagcctattttggtgctggcgatcaggttggttatgcagataattttcaagacgccatgggcattttagaagaaaaaatcagtggattaggcggtaaaacagtggggttttggcccaccgctggctatgattttgacgaatcaaaagcggtgaaaaatgggaaatttgttggtttagctttggacgaagataatcagccagagttaacagaattaagagtaaagacatgggtaagtgaaattaaaccaattttgcaatcctag

SEQ ID NO: 269 - protein, 170 aa, Synechocystis PCC6803
MTKIGLFYGTQTGNTETIAELIQKEMGGDSVVDMMDISQADVDDFRQYSCLIIGCPTWNVGELQSDWEGFYDQLDEIDFNGKKVAYFGAGDQVGYADNFQDAMGILEEKISGLGGKTVGFWPTAGYDFDESKAVKNGKFVGLALDEDNQPELTELRVKTWVSEIKPILQS

SEQ ID NO: 270 - DNA, 585 bp, Streptomyces venezuelae
  CDS (1)..(585): wrbA gene from Streptomyces venezuelae encoding flavodoxin
atgaccacccccgtcgtctccatcgcctaccactccggctacggccacaccgcggtcctggccgaggccgtccgtgacggcgccgccgacgcgggcgccaccgtccacctgatcaaggtcgacgggatcaccgaggcggagtgggagctgctcgacgcctccgacgcgatcgtcttcggctccccgacctacatgggcaccgcctccggtgccttccaccagttcgccgaggactcctcgaagcgctggttcggcgacgtctggctggacaagctcgccgccggcttcaccaactccggctccaagagcggcgacaagctgcacaccctgcagtacttccagatcctcgccggccagcacggcatgcactgggtcaacctcggcctgaagcccggctggaacaccagcgaggcctccgagaacgacatcaaccgcctcggcttcttctccggcgccgccggccagacccccgcggacctgggccccgaggccgtccacaaggccgacgtcgccaccgccgaacacctcggccgccgcgtcgccgagaccgcccgcaccttcgcggccggcaaggccgccgcctga

SEQ ID NO: 271 - protein, 194 aa, Streptomyces venezuelae
MTTPVVSIAYHSGYGHTAVLAEAVRDGAADAGATVHLIKVDGITEAEWELLDASDAIVFGSPTYMGTASGAFHQFAEDSSKRWFGDVWLDKLAAGFTNSGSKSGDKLHTLQYFQILAGQHGMHWVNLGLKPGWNTSEASENDINRLGFFSGAAGQTPADLGPEAVHKADVATAEHLGRRVAETARTFAAGKAAA

SEQ ID NO: 272 - DNA, 459 bp, Methanococcus aeolicus
  CDS (1)..(459): PRK06242 gene from Methanococcus aeolicus encoding flavodoxin
atgaaaatattaattatttgtaaatccgtacaccatggaaacactaaaaaaatagcagatgccatggcagaggttttaaatgcagaggttattgcacctgaaaatgtaagttccgaagatatcaaaaaatatgatttggtgggatttggctctggaatatatattgggaaacatcataaaaagctattaaaacttgcggataatcttccaaatggagaaaataaaacagtatttgtattttccacaagcgataactggaagcaaaattaccataagccattaatggataaactaaattccagaggatataaaacagtaggagaattcaactgtaaagggtttgatgactggtttatatttaaattaattggtggtagaaataaaggacatccaaataaaaaagatattgaaaatgcaaaaaaatttgctgaaaatataaagaatatagaaaatatatag

SEQ ID NO: 273 - protein, 152 aa, Methanococcus aeolicus
MKILIICKSVHHGNTKKIADAMAEVLNAEVIAPENVSSEDIKKYDLVGFGSGIYIGKHHKKLLKLADNLPNGENKTVFVFSTSDNWKQNYHKPLMDKLNSRGYKTVGEFNCKGFDDWFIFKLIGGRNKGHPNKKDIENAKKFAENIKNIENI

SEQ ID NO: 274 - DNA, 336 bp, Escherichia coli
  CDS (1)..(336): fdx gene from E. coli encoding ferredoxin
atgccaaagattgttattttgcctcatcaggatctctgccctgatggcgctgttctggaagctaatagcggtgaaaccattctcgacgcagctctgcgtaacggtatcgagattgaacacgcctgtgaaaaatcctgtgcttgcaccacctgccactgcatcgttcgtgaaggttttgactcactgccggaaagctcagagcaggaagacgacatgctggacaaagcctggggactggagccggaaagccgtttaagctgccaggcgcgcgttaccgacgaagatttagtagtcgaaatcccgcgttacactatcaaccatgcgcgtgagcattaa

SEQ ID NO: 275 - protein, 111 aa, Escherichia coli
MPKIVILPHQDLCPDGAVLEANSGETILDAALRNGIEIEHACEKSCACTTCHCIVREGFDSLPESSEQEDDMLDKAWGLEPESRLSCQARVTDEDLVVEIPRYTINHAREH

SEQ ID NO: 276 - DNA, 249 bp, Bacillus subtilis
  CDS (1)..(249): fer gene from B. subtilis encoding ferredoxin
atggcaaagtacacaatcgtagacaaagatacatgtattgcatgcggcgcttgcggagctgctgcaccagacatttacgattacgatgatgaaggcatcgcgttcgtaacgcttgatgaaaacaaaggtgttgtcgaagttcctgaggtactggaagaagatatgattgacgcatttgaaggatgccctactgattccatcaaagtggcggatgagccatttgaaggcgacccgcttaaatttgaatag

SEQ ID NO: 277 - protein, 82 aa, Bacillus subtilis
MAKYTIVDKDTCIACGACGAAAPDIYDYDDEGIAFVTLDENKGVVEVPEVLEEDMIDAFEGCPTDSIKVADEPFEGDPLKFE

SEQ ID NO: 278 - DNA, 321 bp, Corynebacterium glutamicum
  CDS (1)..(321): fdxB gene from Corynebacterium glutamicum encoding ferredoxin
atgtctactattcatttcattgatcatgctggcaaaacccgcaccatcgaggcgactgttggtgattcagtaatggagaccgcagtccgaaacggagtgcctggaattgttgctgaatgcggcggttccttatcgtgtgcaacctgccatgtgtttgttgaccctgcacagtatgatgcgcttcccccaatggaggagatggaagatgaaatgctgtggggtgctgccgtggaccgtgaggattgctcccgtttgtcttgccaaatcaaggtcaccgaaggcatggatctttcgttgaccacgccagaaacgcaagtgtga

SEQ ID NO: 279 - protein, 106 aa, Corynebacterium glutamicum
MSTIHFIDHAGKTRTIEATVGDSVMETAVRNGVPGIVAECGGSLSCATCHVFVDPAQYDALPPMEEMEDEMLWGAAVDREDCSRLSCQIKVTEGMDLSLTTPETQV

SEQ ID NO: 280 - DNA, 561 bp, Synechocystis PCC6803
  CDS (1)..(561): fdx gene from Synechocystis encoding ferredoxin
atgaccatgccaccattatggaattgctctgtcgccaacagggttaatgccattgttgccagtactaaggaggattgtgtggctaaaactattaagctcgaccccattgatttaaaagtcgccatcgagaccaacgataacctgctctcggggttgctcggtcaggatttacggatcatgaaggagtgtggtggtcggggtatgtgtgccacttgtcacgtttacatcaccgctgggatggagagtctttctcccctcaaccgtcgggagcagcgcaccctagaggtgatcaccacccacaatcgttattcccgtttggcttgccaagcccgggtgttggatgaaggcgtggtggtggaattgcccgctgggatgtacgtcagtgaaattgaggacatcgaggagctgattggccgtcgagcggaggaaaatattctcaatcctcgggatgggagcatcctagtggaaaaaggtaagttaattacccgttccatgattagtcaactagatgaccagttacaggcggccaaaattcagattgtcaacgataccgatgaataa

SEQ ID NO: 281 - protein, 186 aa, Synechocystis PCC6803
MTMPPLWNCSVANRVNAIVASTKEDCVAKTIKLDPIDLKVAIETNDNLLSGLLGQDLRIMKECGGRGMCATCHVYITAGMESLSPLNRREQRTLEVITTHNRYSRLACQARVLDEGVVVELPAGMYVSEIEDIEELIGRRAEENILNPRDGSILVEKGKLITRSMISQLDDQLQAAKIQIVNDTDE

SEQ ID NO: 282 - DNA, 294 bp, Streptomyces venezuelae
  CDS (1)..(294): SVEN_7039 gene from Streptomyces venezuelae encoding ferredoxin
atggcgtacgtcgtcaccgacgagtgcatcggctgcaagtacacggactgtgtggacgtctgccccgtgagctgtttccacgagggccccgagatgctctacatcaaccccgaggaatgcatcgactgcaacgcgtgcgtcgccgagtgcccgcccgaggccatctgggcggacgtcgacctgccggaggacaagctccagtggatcgagatcaacggagagatgagtgccaagtacccggttctccacgagagccggggcccccacggacagccctccagccagccttcctga

SEQ ID NO: 283 - protein, 97 aa, Streptomyces venezuelae
MAYVVTDECIGCKYTDCVDVCPVSCFHEGPEMLYINPEECIDCNACVAECPPEAIWADVDLPEDKLQWIEINGEMSAKYPVLHESRGPHGQPSSQPS

SEQ ID NO: 284 - DNA, 1746 bp, Methanococcus aeolicus
  CDS (1)..(1746): fdx gene from Methanococcus aeolicus encoding ferredoxin
atggggggtgttatgatgtataatattacatacataaaagaggatggaactaaaaaatcaattaaagttaaagaaggaaccacaatacttgaaggagcgataaaagcgggagtttatattgatgctccatgtggaacggggaaatgtggtaagtgtaaagttttagtggagaaaggtttagaaaatattgataaggatagtattgtggaagatgagtatgcactggcatgtgtggcaaaagtttatggggacatatcaattaatgttccaaatttccaaggtgtggtttgtaaggatatcaccaacgaagttggtgagctacaaactcgaagagtttgttcaattaccgaacaatgtaaaggtgagctacaaaatctcgagggatttcatccgatgtctttaaaccccgatattggaataaataaaattactacaacagtattggaatcatctaactataacctaacattagatgcaataaataagcttaattctatgaagttatcggacgaagtaactttaatattaaagggagataatgtcgttaatgtagaaaaagatttttctggaatttatgggctttcaattgatattgggactacatctgttgttgtatatcttgttgatatttctaaaggtattgttttagataatatttcttttttaaatcctcagaggcagtttggggcagatgttgtttcaagaatagcatacaacaacggaattttactgcaaaaaacacttataactgaattaaacgattctatatcaaaattatgttcaaacaataacataaaaatggataatatttatgaagttagtgtggtaggaaacactgctatgatacacttcttttatggaatagtcccaaaaaatcttgcaacccatccttatgttccaacatttaaaaactcaccatatcttcctgcaaaagagttggggctaaacctaagaaacgcatacatttacacacttccgataataggaggttatgttggggcagacacagttggagcaattttatcatctgaaatgcataaaaaagatgatataagtctccttatagatattggcacaaatggggaaattgttttagggaataaagaaaagttattaacctgttcatgtgcagcaggtcctgcatttgagggtgtcagcatagagcatgggacaaatgctagagagggggcagtatgtagagtaaaaatagatgaaaataacatatactatgagaccataggaaataaaacgccccctattggaatatgcgggtctggaataatagatattgtagctgaatttttaaaatccggattaattaataaaaccggtagatttactggagaacataaaaacttaaaggaaaataaatttatcattgaagattctatttatttcacacagggcgatattagggaagtacagcttgcaaaaggggcaatatatgcaggaataaaaattctctgttatgaatatggaataagtatggaagatatatctaatgtatatgttactggagcatttggatgtcatatcgatgttgaaaatgcaaagattatcggacttttaccggatttggataatatattgagtattgataatgctgctggaagggggactataatggctttactatctaaaaaaattagaaatgaagccgataagttggcaaaaaatacgaaatatattgaattaagtagtcatgataattttgaaagtgagttcatatctgcccttgggttttaa

SEQ ID NO: 285 - protein, 581 aa, Methanococcus aeolicus
MGGVMMYNITYIKEDGTKKSIKVKEGTTILEGAIKAGVYIDAPCGTGKCGKCKVLVEKGLENIDKDSIVEDEYALACVAKVYGDISINVPNFQGVVCKDITNEVGELQTRRVCSITEQCKGELQNLEGFHPMSLNPDIGINKITTTVLESSNYNLTLDAINKLNSMKLSDEVTLILKGDNVVNVEKDFSGIYGLSIDIGTTSVVVYLVDISKGIVLDNISFLNPQRQFGADVVSRIAYNNGILLQKTLITELNDSISKLCSNNNIKMDNIYEVSVVGNTAMIHFFYGIVPKNLATHPYVPTFKNSPYLPAKELGLNLRNAYIYTLPIIGGYVGADTVGAILSSEMHKKDDISLLIDIGTNGEIVLGNKEKLLTCSCAAGPAFEGVSIEHGTNAREGAVCRVKIDENNIYYETIGNKTPPIGICGSGIIDIVAEFLKSGLINKTGRFTGEHKNLKENKFIIEDSIYFTQGDIREVQLAKGAIYAGIKILCYEYGISMEDISNVYVTGAFGCHIDVENAKIIGLLPDLDNILSIDNAAGRGTIMALLSKKIRNEADKLAKNTKYIELSSHDNFESEFISALGF

SEQ ID NO: 286 - DNA, 720 bp, Artificial Sequence
  CDS (1)..(720): Synthetic gpf gene encoding GFP
atgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggtaccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaatgatga

SEQ ID NO: 287 - protein, 238 aa, Artificial Sequence
MRKGEELFTGVVPILVELDGDVNGHKFSVRGEGEGDATNGKLTLKFICTTGKLPVPWPTLVTTLTYGVQCFARYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYK

SEQ ID NO: 288 - DNA, 1486 bp, Escherichia coli
  promoter (1)..(36): apFAB306 promoter
  CDS (73)..(603): fldA gene encoding flavodoxin
  CDS (620)..(1366): flpr gene encoding flavodoxin/ferredoxin reductase
  terminator (1400)..(1486)
ttgacaattaatcatccggctcgtagtgtttgtggatggcagtggctagcggccgcagaggttatttcactcatggctatcactggcatctttttcggcagcgacaccggtaataccgaaaatatcgcaaaaatgattcaaaaacagcttggtaaagacgttgccgatgtccatgacattgcaaaaagcagcaaagaagatctggaagcttatgacattctgctgctgggcatcccaacctggtattacggcgaagcgcagtgtgactgggatgacttcttcccgactctcgaagagattgatttcaacggcaaactggttgcgctgtttggttgtggtgaccaggaagattacgccgaatatttctgcgacgcattgggcaccatccgcgacatcattgaaccgcgcggtgcaaccatcgttggtcactggccaactgcgggctatcatttcgaagcatcaaaaggtctggcagatgacgaccactttgtcggtctggctatcgacgaagaccgtcagccggaactgaccgctgaacgtgtagaaaaatgggttaaacagatttctgaagagttgcatctcgacgaaattctcaatgcctgaaaaacaggagaaaaacatggctgattgggtaacaggcaaagtcactaaagtgcagaactggaccgacgccctgtttagtctcaccgttcacgcccccgtgcttccgtttaccgccgggcaatttaccaagcttggccttgaaatcgacggcgaacgcgtccagcgcgcctactcctatgtaaactcgcccgataatcccgatctggagttttacctggtcaccgtccccgatggcaaattaagcccacgactggcggcactgaaaccaggcgatgaagtgcaggtggttagcgaagcggcaggattctttgtgctcgatgaagtgccgcactgcgaaacgctatggatgctggcaaccggtacagcgattggcccttatttatcgattctgcaactaggtaaagatttagatcgcttcaaaaatctggtcctggtgcacgccgcacgttatgccgccgacttaagctatttgccactgatgcaggaactggaaaaacgctacgaaggaaaactgcgcattcagacggtggtcagtcgggaaacggcagcggggtcgctcaccggacggataccggcattaattgaaagtggggaactggaaagcacgattggcctgccgatgaataaagaaaccagccatgtgatgctgtgcggcaatccacagatggtgcgcgatacacaacagttgctgaaagagacccggcagatgacgaaacatttacgtcgccgaccgggccatatgacagcggagcattactggtaatagcttcatatggtccacaggacactcgttgctttcaccatgcgtaaagcaatcagatacccagcccgcctaatgagcgggcttttttttgaacaaaattagagaataacaatgcaaaca

SEQ ID NO: 289 - protein, 176 aa, Escherichia coli; identical to SEQ ID NO: 263

SEQ ID NO: 290 - protein, 248 aa, Escherichia coli; identical to SEQ ID NO: 241

SEQ ID NO: 291 - DNA, 36 bp, Artificial Sequence
  promoter (1)..(36): apFAB309 promoter
ttgacaattaatcatccggctcgtagtgtctgtgga

SEQ ID NO: 292 - DNA, 87 bp, Artificial Sequence
  terminator (1)..(87): apFAB378 terminator
ttcaccatgcgtaaagcaatcagatacccagcccgcctaatgagcgggcttttttttgaacaaaattagagaataacaatgcaaaca

The invention claimed is:

1. A genetically modified bacterium wherein the bacterium has an enhanced production of biotin or lipoic acid or thiamine; wherein said bacterium comprises:
   a. a genetically modified endogenous iscR gene encoding a mutant
   IscR polypeptide, wherein the amino acid sequence of said mutant IscR polypeptide has at least 80% amino acid sequence identity to a sequence selected from the group consisting of SEQ ID No: 2, 4, 6, 8, 10, 12 and 14, and wherein said amino acid sequence has at least one amino acid substitution selected from the group consisting of:
   i) L15X, C92X, C98X, C104X, and H 107X; wherein X is any amino acid other than the corresponding amino acid residue in SEQ ID No.: 2, 4, 6, 8, 10, 12 and 14; and
   b. at least one transgene encoding a polypeptide selected from the group consisting of:
   ii) a polypeptide having biotin synthase activity (EC 2.8.1.6),
   iii) a polypeptide having lipoic acid synthase activity (EC 2.8.1.8),
   iv). a polypeptide having HMP-P synthase activity (EC 4.1.99.17), and
   v). a polypeptide having tyrosine lyase activity (EC 4.1.99.19).

2. A genetically modified bacterium for enhanced production of biotin or lipoic acid or thiamine according to claim 1, wherein said at least one amino acid substitution in said mutant IscR polypeptide is selected from the group consisting of:
   a) L15X, wherein X is any one of F, Y, M and W;
   b) C92X, wherein X is any one of Y, A, M, F and W;
   c) C98X, wherein X is any one of A, V, I, L, F and W;
   d) C104X, wherein X is any one of A V, I, L, F and W; and
   e) H 107X; wherein X, is any one of A, Y, V, I, and L.

3. A genetically modified bacterium according to claim 1, wherein said at least one transgene encodes a polypeptide having biotin synthase activity (EC 2.8.1.6), further comprising additional transgenes encoding one or more polypeptides selected from the group consisting of:
   a) a polypeptide having SAM (S-adenosylmethionine)-dependent methyltransferase activity (EC 2.1.1.197);

b) a polypeptide having 7-keto-8-aminopelargonic acid (KAPA) synthase activity (EC 2.3.1.47);
c) a polypeptide having 7,8-Diaminopelargonic Acid (DAPA) Synthase activity (EC: 2.6.1.62 or EC: 2.6.1.105);
d) a polypeptide having Dethiobiotin (DTB) Synthetase activity (EC 6.3.3.3),
e) a polypeptide having Pimeloyl-[acyl-carrier protein] methyl ester esterase (EC 3.1.1.85), and
f) a polypeptide having 6-carboxyhexanoate-CoA ligase activity (EC 6.2.1.14);
wherein said bacterium is for enhanced production of biotin.

4. A genetically modified bacterium according to claim 1, wherein said at least one transgene encodes a polypeptide having lipoic acid synthase activity (EC 2.8.1.8), further comprising additional transgenes encoding one or more polypeptides selected from the group consisting of:
a) a polypeptide having octanoyltransferase activity (EC 2.3.1.181),
b) a polypeptide comprising the dihydrolipoyllysine-residue acetyltransferase component of pyruvate dehydrogenase (EC 2.3.1.12), and
c) a polypeptide having lipoate-protein ligase A activity (EC: 6.3.1.20),
wherein said bacterium is for enhanced production of lipoic acid.

5. A genetically modified bacterium according to claim 1, wherein said at least one transgene encodes a polypeptide having HMP-P synthase activity (EC 4.1.99.17), and/or one transgene encoding a polypeptide having tyrosine lyase activity (EC 4.1.99.19), further comprising additional transgenes encoding one or more polypeptides selected from the group consisting of:
a) a ThiF polypeptide having ThiS adenylyltransferase activity (EC 2.7.7.73),
b) a ThiE polypeptide having thiamine phosphate synthase activity (EC 2.5.1.3),
c) a ThiG polypeptide having thiazole synthase activity (E.C. 2.8.1.10),
d) a ThiD polypeptide having phosphohydroxymethylpyrimidine kinase activity (EC 2.7.4.7),
e) a ThiO polypeptide having glycine oxidase activity (EC 1.4.3.19);
f) a ThiS polypeptide having sulfur-carrier protein activity,
g) a ThiM polypeptide having hydroxyethylthiazole kinase activity (2.7.1.50), and
h) a polypeptide having thiamine mono-phosphate phosphatase activity (E.C. 3.1.3.-),
wherein said bacterium is for enhanced production of thiamine.

6. A genetically modified bacterium according to claim 5, wherein said bacterium comprises the additional transgenes encoding:
a) a ThiC polypeptide having HMP-P synthase activity (EC 4.1.99.17),
b) a ThiH polypeptide having tyrosine lyase activity (EC 4.1.99.19) or a ThiO polypeptide having glycine oxidase activity (EC 1.4.3.19),
c) a ThiF polypeptide having ThiS adenylyltransferase activity (EC 2.7.7.73),
d) a ThiE polypeptide having thiamine phosphate synthase activity (EC 2.5.1.3),
e) a ThiG polypeptide having thiazole synthase activity (E.C. 2.8.1.10),
f) a ThiD polypeptide having phosphohydroxymethylpyrimidine kinase activity (EC 2.7.4.7),
g) a ThiS polypeptide having sulfur-carrier protein activity; and
h) a polypeptide having thiamine mono-phosphate phosphatase (E.C. 3.1.3.-) activity.

7. A genetically modified bacterium according to claim 1, wherein said at least one transgene and said one or more additional transgenes are operably linked to a constitutive promoter.

8. A genetically modified bacterium according to claim 1, wherein said bacterium is a genus of bacterium selected from the group consisting of *Escherichia, Bacillus, Brevibacterium, Burkholderia Campylobacter, Corynebacterium, Pseudomonas, Serratia Lactobacillus, Lactococcus, Acinetobacter, Pseudomonas,* and *Acetobacter.*

9. A method for producing biotin, comprising the steps of:
a) introducing a genetically modified bacterium according to claim 1, wherein at least one said transgene encodes a polypeptide having biotin synthase activity (EC 2.8.1.6), into a growth medium to produce a culture;
b) cultivating the culture; and
c) recovering biotin produced by said culture, and optionally purifying the recovered biotin.

10. A method for producing lipoic acid comprising the steps of:
a) introducing a genetically modified bacterium according to claim 1, wherein at least one said transgene encodes a polypeptide having lipoic acid synthase activity (EC 2.8.1.6), into a growth medium to produce a culture;
b) cultivating the culture; and
c) recovering lipoic acid produced by said culture, and optionally purifying the recovered lipoic acid.

11. A method for producing thiamine comprising the steps of:
a) introducing a genetically modified bacterium according to claim 1, wherein at least one said transgene encodes a polypeptide having HMP-P synthase activity (EC 4.1.99.17), and/or a transgene encoding a polypeptide having tyrosine lyase activity (EC 4.1.99.19) into a growth medium to produce a culture;
b) cultivating the culture; and
c) recovering thiamine produced by said culture, and optionally purifying the recovered thiamine.

12. A method for producing any one of biotin, lipoic acid and thiamine according to claim 9, wherein the growth medium comprises a carbon source selected from among glucose, maltose, galactose, fructose, sucrose, arabinose, xylose, raffinose, mannose, and lactose, or any combination thereof.

13. The method of a genetically modified gene encoding a mutant iscR polypeptide to enhance production of any one of biotin, lipoic acid or thiamine in a genetically modified bacterium, wherein said bacterium comprises and expresses at least one transgene encoding a polypeptide selected from the group consisting of:
i) a polypeptide having biotin synthase activity (EC 2.8.1.6),
ii) a polypeptide having lipoic acid synthase activity (EC 2.8.1.8),
iii) a polypeptide having HMP-P synthase activity (EC 4.1.99.17), and
iv) a polypeptide having tyrosine lyase activity (EC 4.1.99.19), and
wherein said genetically modified gene is an endogenous iscR gene encoding a mutant IscR polypeptide, wherein the amino acid sequence of said mutant IscR polypeptide has at least 80% amino acid sequence identity to SEQ ID No.: 2, 4, 6, 8, 10, 12 and 14, and wherein the amino acid sequence has at least one amino acid substitution selected from the group consisting of: L15X, C92X, C98X, C104X, and H 107X; wherein X is any amino acid other than the corresponding amino acid residue in SEQ ID No 2, 4, 6, 8, 10, 12 and 14.

14. The method of using a genetically modified gene encoding a mutant iscR polypeptide to enhance production of any one of biotin, lipoic acid or thiamine in a genetically modified bacterium according to claim 13, wherein said at least one amino acid substitution in said mutant IscR polypeptide is selected from the group consisting of:
   a) L15X, wherein X is any one of F, Y, M and W;
   b) C92X, wherein X is any one of Y, A, M, F and W;
   c) C98X, wherein X is any one of A, V, I, L, F and W;
   d) C104X wherein X is any one of A V, I, L, F and W; and
   e) H 107X; wherein X, is any one of A, Y, V, I, and L.

15. The method of using a genetically modified bacterium according to claim 1, for enhanced production of any one of biotin, lipoic acid or thiamine.

16. A genetically modified bacterium according to claim 1, wherein said bacterium further comprises one or more genes selected from the group:
   a) a gene encoding a flavodoxin/ferredoxin-NADP reductase (EC: 1.18.1.2 and EC 1.19.1.1);
   b) a gene encoding a pyruvate-flavodoxin/ferredoxin oxidoreductase (EC 1.2.7);
   c) a gene encoding a flavodoxin;
   d) a gene encoding a ferredoxin; and
   e) a gene encoding a flavodoxin and a ferredoxin-NADP reductase; wherein said one or more genes are operably-linked to a non-native promoter capable of enhancing expression of said one or more gene in said bacterium, and wherein said one or more gene may be a native gene or a transgene.

17. The method of using a genetically modified bacterium according to claim 16 for enhanced production of any one of biotin, lipoic acid or thiamine.

18. A method for producing any one of biotin, lipoic acid and thiamine according to claim 9, wherein said genetically modified bacterium further comprises one or more genes selected from the group:
   a) a gene encoding a flavodoxin/ferredoxin-NADP reductase (EC: 1.18.1.2 and EC 1.19.1.1);
   b) a gene encoding a pyruvate-flavodoxin/ferredoxin oxidoreductase (EC 1.2.7);
   c) a gene encoding a flavodoxin;
   d) a gene encoding a ferredoxin; and
   e) a gene encoding a flavodoxin and a ferredoxin-NADP reductase; wherein said one or more genes are operably-linked to a non-native promoter capable of enhancing expression of said one or more gene in said bacterium, and wherein said one or more gene may be a native gene or a transgene.

\* \* \* \* \*